United States Patent 8,344,211 (PLANT NUCLEOTIDE SEQUENCES AND CORRESPONDING POLYPEPTIDES) - sequence listing, part 23

SEQ ID NO: 86535 - DNA, 784 bp, Zea mays
  misc_feature: Ceres CLONE 1572969
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttnnnnngggaaagctggagctccacgagggggcggccgctctagaatagtggatcccccgggctgcaggaattcgtctcacccctagaaaaagaaaaaacggcatcttcttttggtcatttgcttgctacactgacaggttctcagagcagaggcatccgggcacccctggtaggcttccactgccactgagaatttggttctgggaagagagaaagctgcacgattcttcctcaccttgggcctcactcctggctccatggctggaattgaaacacggaaagcaagctcccgggaacctgggttggcccaaaggaaggcccaccccctcctgggggcttggccctggggaaaagggggggggaaaaggtttttttttgcttggccctttccccccccccccgggggcccccggggggggggcttggccccccccttcccttttcgggggggggccctttttggggggggggggggcccccggggaaaaaaaggggggggggggcccctttttttttnnnnnccccccccccccccaagggggggggggggggggaaaaaaaaaccctcttttttgaaaaaaaaatttttttaaaaaaaggggccccccccccccccccggggggggggggggggggcccccccccagaagaaaaaaaaatatttttttcccccccccgagaga

SEQ ID NO: 86536 - DNA, 876 bp, Zea mays
  misc_feature: Ceres CLONE 1572970
  misc_feature: Translation starting site: 233
aaaagctggagctccccgcggtggcggccgctctagaactagtggatcccccgggctgcaggaattcgtctcacccctagaaaaaaatgcctctctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccaagtgcaacccctgggatctccctgccaaggcattgttcggcgacaaggagtggtttttcttcagcccccggggaccgcaaagttaccccaacgggcgcccggcccccaaccgcgcccgccggggtcccggggtaactggaagggcccccgggcacccaaacaaagggccaatcccttgtcggtccgatcccacgcccccaccaagccactggcgggcggccaaacatccgtcgtccagcggtcaaggaaaggcgcttcgtctttcttacggcgggcagggcccgccccaaggggcaaccaaagaacggaactggaattcatggccccgaagtacccgccctcctccggggcggccggccgtgaacgaacatactggccaaggggccagccaccacagggcgccaaaaatgtggcccttcctttcctctggggccgtgccctcccattgaaagggctggg

SEQ ID NO: 86537 - DNA, 750 bp, Zea mays
  misc_feature: Ceres CLONE 1572971
  misc_feature: Encodes the peptide sequence at SEQ ID NO. 86538
ccccgcggtggcggccgctctagaactagtggatcccccgggctgcaggaattcgtctcacccctagaaaaagctttccgattttcgtttctctctcttttcctttccccccgtccctctctttctttctctcttggaattggaattggactcaaaagtttcggcggccttctccatgaacacggtggcttcgctgcctttggcgccgcgcctactcattaagccctccctcgcctgcttctccagaaaggacgtcgcccgctatggcgggatcaaggtgtacgccgtgctcagggaagacggggccgagttcgcccggaacaacaacctgggggccctgttccaggtggacgaccccgggccgcgggcccccgtcaagaagttcctggacgtgaacgaggctctggaggtggtccgcttcgacatccagtactgcgactggagggcgcgccaggatctcctcaccatcatgcttctccacagcaaggtggtggaggtcctcaaccctctggcgagggagttcaagtccatcgggaccttgaggaaagagctcgccgagctacagcaggagctggaaaaagctcacaatcaagtccatctctcggaagccagagtctcatcggcgctcgacaagctagcgcatatggagaccctggtgagcgcatcatccacagccgagccggccactttctccctccctggctgcaactgcaactgcaactgcaactgcaagcagcaccgccccgtgtt

SEQ ID NO: 86538 - protein, 191 aa, Zea mays
  misc_feature: Ceres CLONE 1572971
  misc_feature: SWISSPROT Homolog: EC 1.13.12.14 Chlorophyllide-a oxygenase
MNTVASLPLAPRLLIKPSLACFSRKDVARYGGIKVYAVLREDGAEFARNNNLGALFQVDDPGPRAPVKKFLDVNEALEVVRFDIQYCDWRARQDLLTIMLLHSKVVEVLNPLAREFKSIGTLRKELAELQQELEKAHNQVHLSEARVSSALDKLAHMETLVSASSTAEPATFSLPGCNCNCNCNCKQHRPV

SEQ ID NO: 86539 - DNA, 755 bp, Zea mays
  misc_feature: Ceres CLONE 1572973
  misc_feature: Encodes the peptide sequence at SEQ ID NO. 86540
  misc_feature (755)..(755): n is a, c, t, g, unknown, or other
ctggagctcaccgcggtggcggccgctctagaactagtggatcccccgggctgcaggaattcgtctcacccctagaaaaagccaccaactcacgcagcgtgcttcccttcagaaactcgatggcctgccacctcgccatcgccggcgccaccgccgccgccgcccgcgctcctcgtatctccgtgctcgccgccgcctctgcttcctccgcaggggaacccgcgcgccgcatcatccgccgccgcgcgccgccgggtcagcagggctctgccacagcggcccccgcgcctcccgcccagccgtccgtggcggaggtgcgccgcgccatcggcgtctccgacgacgctgcgtcggccgccgcatccatggagaagaagaacaccgcgttcatggacctcatctctaccacgcccatcggccagccggagagcgagcccgagcgccgcctccgcgaggccgccgagtgggtagtcgacaccactgagacgcgcgcttgcgaaggacagaagtctttcttagtgctatgcatgatgacatttcctgcttggttcttgctcctgtttcttgcccttggactctttaagttaccatttgatattccggttctggataatctcctaatgtaaggtgttagctattatcattttttcccttttatttttccaaatatacgagcttcacacactggaatatgaaaagaaatatatgcccactactggaagttcacttcctccccctttttccaaaatttatan

SEQ ID NO: 86540 - protein, 168 aa, Zea mays
  misc_feature: Ceres CLONE 1572973
MACHLAIAGATAAAARAPRISVLAAASASSAGEPARRIIRRRAPPGQQGSATAAPAPPAQPSVAEVRRAIGVSDDAASAAASMEKKNTAFMDLISTTPIGQPESEPERRLREAAEWVVDTTETRACEGQKSFLVLCMMTFPAWFLLLFLALGLFKLPFDIPVLDNLLM

SEQ ID NO: 86541 - DNA, 806 bp, Zea mays
  misc_feature: Ceres CLONE 1572975
  misc_feature: Encodes the peptide sequence at SEQ ID NO. 86542
cggccgctctagaactagtggatcccccgggctgcaggaattcgtctcacccctagaaaaaaagcgtatcctctcctcaaccaagtggagcatcccctcacgctagaccggagctggggggcgacgacgagccagccgccgccggtttgaccagacctgtggtgatggactgattaggtatgcctgtaggagggagagagctttcgggttagaaaataagagggtgccgcgggctggactgagagagcggaaggaaggaaggagccggcgatgggcgggtggaactggctcttctgcggccgatccaaagccggaggcggcgagctgcggcctcccgaggccttacagctgccggcgcccttgcccgagtggccgcagggaggggattttgctaagggcacggtatgcataggacaggttgatgttacaagtattcccaaattccggtactatcggacctgcccaaatgctacattttatgaagccagaagggaattcctgatggtttccactgccttgggtaacttaggcccaaactgaatgaacggcccccttacaggggatttccttcttggtggcaaagggaagtggcctaccccccaaatttttttgataccaacgcccgcccttgggagaatcctctagattactccccttgtcttggaacaagggctggactcaaatggaagatgccattcccggttggggggttcgcatttgggctttgcttgttcaccccaatggggtgataaaggcccttgggcttgtggttactaaaggaccaaaataactcctccctgcacggg

SEQ ID NO: 86542 - protein, 89 aa, Zea mays
  misc_feature: Ceres CLONE 1572975
MGGWNWLFCGRSKAGGGELRPPEALQLPAPLPEWPQGGDFAKGTVCIGQVDVTSIPKFRYYRTCPNATFYEARREFLMVSTALGNLGPN

SEQ ID NO: 86543 - DNA, 1182 bp, Zea mays
  misc_feature: Ceres CLONE 1572978
  misc_feature: Encodes the peptide sequence at SEQ ID NO. 86544
  misc_feature (11)..(11): n is a, c, t, g, unknown, or other
  misc_feature (12)..(12): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (53)..(53): n is a, c, t, g, unknown, or other
  misc_feature (54)..(54): n is a, c, t, g, unknown, or other
  misc_feature (59)..(59): n is a, c, t, g, unknown, or other
  misc_feature (60)..(60): n is a, c, t, g, unknown, or other
  misc_feature (63)..(63): n is a, c, t, g, unknown, or other
  misc_feature (72)..(72): n is a, c, t, g, unknown, or other
  misc_feature (75)..(75): n is a, c, t, g, unknown, or other
ttttgttgtgnntttttttttttttttcgttttttnnnnngnncgcggggtgnnttatnnagncgattatanaanacaaagctggagctcacctcggtggcggccgctctagaactagtggatcccccgggctgcaggaattcgtctcacccctagaaaaatcctcctccccgtctccggctccaacccgcaagcgcggtaaggtatggcttcgacattcggtgccacttctactgtcggccttatggctgctccaacagggaagaatgtgcgccttcatacgacggtgaacttcatagtaagagcagctatggagctgtacttcaacaaggatggctcagctatcaaaaagctccagacttggagtcaataatcttgcaaaacctaatcggtagttacaccttgtaaccaaagggaaggaaatgttgtttttggaaaacctagttagggttccttcctaaaaaatttgataaccaatggggggttaccggcttcccaaaaaaaggttatgattcttggaatgtaacccctgagggaacaaactttggagacgcttaaacttggttctcacggcaaagctattcacgcctaaagtaaacaactggtaatctctcgtcttgtgtaattatggggtaacaaaatgctcccttttcttggtgtgggttccctggtgacttacagggtgttgtgatgaattattcgctttcaaaaggggtgtgatcttttaatgtgatgttctgggagttaaacacgattttcatttggtttttaaagttccccgatgctatcacgccagatgtatactctacgtttgaggcgaaactcatctccgaggtgttataacctatctgcttgaatcaatgtctacgacttgtctcttccttatagaagacagttatgacaagggtgaaagtattttcgtctgttgaagagtcgtgagcatgtgctgctgctagcgtctaagcttcattctgagacaacttttggtcaagaagtccgctgcgggcccctcttctttttgagtatcgaaggttgcgctgagatggctaacacataacggtaaatccatacatactggttgttgtgcgtcacaatatctatatccctaactactctacagtatagatgtccccacctggagggaaattttgagctgttcacgtgcacagctggacactggtg

SEQ ID NO: 86544 - protein, 55 aa, Zea mays
  misc_feature: Ceres CLONE 1572978
MASTFGATSTVGLMAAPTGKNVRLHTTVNFIVRAAMELYFNKDGSAIKKLQTWSQ

SEQ ID NO: 86545 - DNA, 771 bp, Zea mays
  misc_feature: Ceres CLONE 1572982
  misc_feature: Encodes the peptide sequence at SEQ ID NO. 86546
  misc_feature (415)..(415): n is a, c, t, g, unknown, or other
ctggagctccccgcggtggcggccgctctagaactagtggatcccccgggctgcaggaattcgtctcacccctagaaaaagtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcaggggaggcgtaccngtccgcgagacggcccgcgccgggcctacgtcatacccggaggagccgcccggcccgtgggtccgagctccgtccggctgggtacaatcttacgggctttctggctccctaactttcaatcaccccacccttgcctgggctggccggggtccctcctttccccgggcccatcaatcaacgccagggttcggccttttcccccaaaattcccgaaactttcaccgcccccggaaccccccaaagttaacacccccctccaaagggggcgggttcaacccctggcccttccggttcccccaaacgaaagaaatggggtccccccatgggttgtaccccaaggaaaggagggctttttt

SEQ ID NO: 86546 - protein, 199 aa, Zea mays
  misc_feature: Ceres CLONE 1572982
MSEQQQPLPQPRSSMREALEKEDKEKAAAAAAAKEKAAVPKNGNGNGGKNGGGAGSGNGGAPPQSGEETAREIQVVRGGVPVRETARAGPTSYPEEPPGPWVRAPSGWVQSYGLSGSLTFNHPTLAWAGRGPSFPRAHQSTPGFGLFPQNSRNFHRPRNPPKLTPPSKGGGFNPWPFRFPQTKEMGSPHGLYPKERRAF

SEQ ID NO: 86547 - DNA, 786 bp, Zea mays
  misc_feature: Ceres CLONE 1572984
  misc_feature: Encodes the peptide sequence at SEQ ID NO. 86548
cggccgcaatcgaactagtggatcccccgggctgcatgcattcgtctcacccctagaaaaaacgcgctgctggtagcccgcagctacctgcctcccttcttgcacccaccgctgccgtcctgcccagatcccgctcgccggtggtgctcccctccccccgcgccgctggcgccgccggagcgagggggactgcccaaaccctagtgggagttggagactaggaggaagggcgcgagatccggcggcggccaccccgatgggggacttcaacgtcgcgctggtgatcgtggcggcggtggtcagcgtgctggtgctgctcgtcagcgtctacctgctcgtcaactaccagcaccccgacgacgtcaaccaggcctacttccccaagctcgtcgtcgtgctcggcctcaccgtcgccgtcctctcaatcctcatgctccctgccgacgtcgccaatcgccaggcctgccgcaaggccgtctacaacggcgcctgcagtctcacgctccccatgaggacgctctggctcgtcgtctacatcgtagacgccgtcctcgtcttcctcgtcatccccttcgccatgttctactacgagggcgaccaggacaagtccgtcgggaagaagctaaggactgcgctcatctgggtcgtcgcgtcggcggggggtgtgcgggctcgtccctcggcattctattacggacttggttgggaaagtgggacttcccctggggagggaaccttatctttcatcggggccaggacatttttcaaaacttcatttttccggga

SEQ ID NO: 86548 - protein, 176 aa, Zea mays
  misc_feature: Ceres CLONE 1572984
MGDFNVALVIVAAVVSVLVLLVSVYLLVNYQHPDDVNQAYFPKLVVVLGLTVAVLSILMLPADVANRQACRKAVYNGACSLTLPMRTLWLVVYIVDAVLVFLVIPFAMFYYEGDQDKSVGKKLRTALIWVVASAGGVRARPSAFYYGLGWESGTSPGEGTLSFIGARTFFKTSFFR

SEQ ID NO: 86549 - DNA, 819 bp, Zea mays
  misc_feature: Ceres CLONE 1572991
caaagctggagctcaccgcggtggcggccgctctagaactagtggatcccccgggctgcaggaattcgtctcacccctagaaaattatgtgtgtgaccaacaattcaacacaactccagggagcacagtgtgcactaaacaaatctgcaggtttaaatgcacgattctcaggtcttacttctacatagcacacaaattttaaggaccccaacataatctatctcactcaatctcagattacattattgaattatccttgatatatattctttcctaaagcttgaacaaaactaggatcatcacctagctatggtcattcatcattttctttttactatcaagcattttaacagctaatttcatatgtcaaccctcaacacgcatatttattgtttggagatgaacaatacctgtacatttatcaagaggcttacaaagctgccatgcgctatctccatcatgatccttggtaacgatcctaatatctattccttacagctgggttataggacataaatctggtactgttggattcacatttaaagttactttatatgatatacattcatggtcatatgcgcatgtagttatgaaaagaaatgatggtaaaatatacggatttgatgaaacacatgcagatatcccgtaccaccaaaaagggtgtaccctaccctgcgaatgacttactgttggtttaagctctaacgggtcatgggccccctgctttaaaaaccaaaaaatgaaaaaattccctcccaaagggtaccttggcaaaggttaattattgaaactctcggggggcaacctggtattaggccc

SEQ ID NO: 86550 - DNA, 1039 bp, Zea mays
  misc_feature: Ceres CLONE 1572996
  misc_feature: Encodes the peptide sequence at SEQ ID NO. 86551
  misc_feature (12)..(12): n is a, c, t, g, unknown, or other
  misc_feature (14)..(14): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (54)..(54): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ggggttgagaancnccccggcgggagaaaaaaattaaaataannnnanccaggnnctgnnnnngtttnnnnnnaaaaactggggctcaccgcggtggcggccgctctagactagtggatcccccgggctgcaggaattcgtctcacccctagaaaaagtagccaccgctgctgactctgcttcctcctgcgtcgcccacctccgctgctgctgtcgcgttagttgctgccgttgttgaagacgcgtagctctttagggttcgcgatttctcgccgatcggttcgagaattggtaagctatggatctctcgcggcccacatcgtcggacctctcgctcgggctccactctcacggtcacgcccacgcccacgctcgcaggcacgcggtagccgcgccgctgcgcctgttcgacgacgcggaggagccgaagccggagcgcgtcgtggccggagaggccgacgcggagagggatgacgaggacgggggcgaccagcacttctccctcctcgggcactccctcttcgtcaagcgcccgcgccgcgcccggcaaaggcgggcggggggccggagagacgtccatcctgcctcggccaacttcccgcgggcgctttcgcccctggccaagcgaacaggccgaacgggggggaaggggcaagccggcctccagaaatccttgggaagaaacccggcccgccggcccggggggttcccggcggccccttgggggggaaaattcatagtcccgcctggggccggggaagggcccccaaacacccggggaacggtgggcaccttcccgccctgaaattgggagaccccaggagaattttggggaacccgccccacagggggtgccgaaaggcgcatcccctaagccttctcattaaaccctgttcccgggaaaaaaaacatttccgtgtcctggggccccccgcccgggggggcgcttccccaaataggaacacctcgggcgtgagaggtccccccccctctctaacttattacaaaaaagttgctcctccccgcgagagaggggggg

SEQ ID NO: 86551 - protein, 168 aa, Zea mays
  misc_feature: Ceres CLONE 1572996
MDLSRPTSSDLSLGLHSHGHAHAHARRHAVAAPLRLFDDAEEPKPERVVAGEADAERDDEDGGDQHFSLLGHSLFVKRPRRARQRRAGGRRDVHPASANFPRALSPLAKRTGRTGGKGQAGLQKSLGRNPARRPGGFPAAPWGGKFIVPPGAGEGPPNTRGTVGTFPP

SEQ ID NO: 86552 - DNA, 742 bp, Zea mays
  misc_feature: Ceres CLONE 1573003
  misc_feature: Encodes the peptide sequence at SEQ ID NO. 86553
  misc_feature (678)..(678): n is a, c, t, g, unknown, or other
  misc_feature (696)..(696): n is a, c, t, g, unknown, or other
ctggagctcaccgcggtggcggccgctctagaatagtggatcccccgggctgcaggaattcgtctcacccctagaaaaaacctagaaaaaacccttcatccaccagccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacagaaggcagttgaaaggctcgatgggagattggtagacgggagggagatcatggtgcagtttgccaagtacggcccaaatgctgaacggattaataaagggagaatagtggagccagttccaagaccaggggggcgttccaggagtcacagtccaagacggaggtaccgtgatgattatcgagatgaccatgatagagattatagaaggcgaagtcgtagccggagtagagatagatacacccgtgacaggtacagggatagggattaccgccatcgtagcccgagtcgcagctacagtcctgatgattancagaagcgtggggagagnacagtttgtcacctgagcgaagaaagccctcgtccgtagccgcagt

SEQ ID NO: 86553 - protein, 193 aa, Zea mays
  misc_feature: Ceres CLONE 1573003
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (175)..(175): Xaa is any aa, unknown, or other
  misc_feature (181)..(181): Xaa is any aa, unknown, or other
MSRFGRSGPPPPIRDTYSLLVLNITFRTTADDLFPLFDKYGEIVDIYIPRDRRTGDSRGFAFVRYKYEDEAQKAVERLDGRLVDGREIMVQFAKYGPNAERINKGRIVEPVPRPGGRSRSHSPRRRYRDDYRDDHDRDYRRRSRSRSRDRYTRDRYRDRDYRHRSPSRSYSPDDXQKRGEXTVCHLSEESPRP

SEQ ID NO: 86554 - DNA, 779 bp, Zea mays
  misc_feature: Ceres CLONE 1573006
  misc_feature: Encodes the peptide sequence at SEQ ID NO. 86555
ctggagctccccgcggtggcggccgctctagaactagtggatcccccgggctgcaggaattcgtctcacccctagaaaaatatttgcgccagagggcagggcaggggccttggcgctacccccgttcttatccccaccccacctcgtgcctcccctcctccccccttcccctctctcgcccctcctccctccgtctcgtctcccaggtcatggcaaaagctggagcaccgggaaaaatagcaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaaactgggcttcgcctcactcatgccgcagacgtcctccggcgaccagtgcgtgatgggggaggggtgatcttgtggacccacgccagacagcttcccggacgccgtggaagacgacagcgatgacgacgttgaagacatcgaggaactggagcgccccatgtggcgcgaccccagaaagctgaaacggctcagggagctgcagcagagccgcggcaaaggacccatgggctagcggggggggggcctaacccgaaggctcatccaagccaaaagcaggccccagga

SEQ ID NO: 86555 - protein, 52 aa, Zea mays
  misc_feature: Ceres CLONE 1573006
MMGGGLMMDQSVVFPGVHNFVDLLQQNGDKKLGFASLMPQTSSGDQCVMGEG

SEQ ID NO: 86556 - DNA, 799 bp, Zea mays
  misc_feature: Ceres CLONE 1573007
  misc_feature: Encodes the peptide sequence at SEQ ID NO. 86557
tccccgcggtggcggccgctctagaatagtggatcccccgggctgcaggaattcgtctcacccctagaaaaacccaaggctgctgccgccgcctgccgctaggggatcgcttgctttcctcggaccactctgccgaccacatctacaccgcatcaacggtccttccaagtgagctccaatcccctgtctgtagatggagagggtgctaaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgtgactgttacaaatgatggggctaccattttgaagtcacttcacattgacaatcctgctgcaaaggtccttgttgacatctcaaaaggtcaagatgacgaagttggtgatgggacaacttctgttgttgttctagccggagaacttttgaaagaggctgagaaagtaattaacatgaaaattcatccgatgacctattattgcagggttacaaaatgggctctcgagtgtgccagaagattccttgtgctaaaaaaaaacctgtggccacccaggaaaaattcggttaaatttccgatcctgattccccctgaaatattggctttggaaccacccccttaggttcaaaaaatacctttccccaaaaaacaagggtggtccttccccctgaaaccttggcggggttgaattccctgtcccttggaggggctttaaaggggtgaaccc

SEQ ID NO: 86557 - protein, 166 aa, Zea mays
  misc_feature: Ceres CLONE 1573007
MERVLKDDAVEEKGERARMASFVGAMAISDLVKTTLGPKGMDKILQSTGRGRNVTVTNDGATILKSLHIDNPAAKVLVDISKGQDDEVGDGTTSVVVLAGELLKEAEKVINMKIHPMTYYCRVTKWALECARRFLVLKKNLWPPRKNSVKFPILIPPEILALEPPP

SEQ ID NO: 86558 - DNA, 939 bp, Zea mays
  misc_feature: Ceres CLONE 1573008
  misc_feature: Translation starting site: 278
  misc_feature: SWISSPROT Homolog: EC 1.4.1.2 Glutamate dehydrogenase
  misc_feature (1)..(1): n is a, c, t, g, unknown, or other
  misc_feature (26)..(26): n is a, c, t, g, unknown, or other
  misc_feature (27)..(27): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (89)..(89): n is a, c, t, g, unknown, or other
  misc_feature (915)..(915): n is a, c, t, g, unknown, or other
ntttttttggtgggggggggaggggnnaagcaaggggagaggggttgggggggttcggggggggtggtggggggnnnnccaaagctggnactccccgcggtggcggccgcttccgaactagtggatcccccgggctgcatgccttcggcgcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaaggggggagggagaaacaggttgcagccgaagagatctcctccatgggtctcatcaagaggcggggagaccgctgaagcttaccctgggcagcacgaaccaagaaaggccggtggtcacgggtccctggcctacttcaaacgaaccaacagaagggcagggcaacaaaaggaaggccggggggggaaatggtgggggcctcaaaggggccggggcgaacccgcccaagggaagcccaacccggctggcggggcaaattggccactatgggggcctgtggaccaaggaaagggggaaaaccagtnccgttcggggggggaaaaaaaaaa

SEQ ID NO: 86559 - DNA, 771 bp, Zea mays
  misc_feature: Ceres CLONE 1573009
  misc_feature: Encodes the peptide sequence at SEQ ID NO. 86560
  misc_feature (771)..(771): n is a, c, t, g, unknown, or other
gaaagctggagctcaccgcggtggcggccgctctagaactagtggatcccccgggctgcaggaattcgtctcacccctagaaaaaaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggn

SEQ ID NO: 86560 - protein, 209 aa, Zea mays
  misc_feature: Ceres CLONE 1573009
  misc_feature (62)..(209): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANG

SEQ ID NO: 86561 - DNA, 783 bp, Zea mays
  misc_feature: Ceres CLONE 1573011
  misc_feature: Encodes the peptide sequence at SEQ ID NO. 86562
  misc_feature (713)..(713): n is a, c, t, g, unknown, or other
ctggagctccccgcggtggcggccgctctagaactagtggatcccccgggctgcaggaattcgtctcacccctagaaaaagggagagaaagccagacaggactcctcctcccccttccctccccctaaaagctaaaaacatttggagagagagagagagggagatcgaggggaaaccgagcaaccaagacgcacacgacgatggagcgagaggacgcgtgccgggtggcgctgctggacgcggccggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcaggccttcgccggccacctcggcgacctcgagctcgccgccatctccatcgccaacaccgtcgtcgtcggcttcaacttcggcctcatgttgggcatggcgagcgcgctggagacgctgtgcgggcaggcgttcggcgcgaagaagttccacatgatgggcgtgtacatgcagcggtcgtggatcgtgctgttcatgtgcgcggtgctgctgctgcccatgtacttcttcgcggaggacgtgctgctgctgacggggcagccgccggagctggcggcgatggcggggaaagtgtgcgtgtggttcatcccgctgcacttctccttcgccttcctcttnccgctgcagcgcttcctgcagtgccagatgaagtatactcgcaacgccgccgcccgcgcagccgcgctcc

SEQ ID NO: 86562 - protein, 194 aa, Zea mays
  misc_feature: Ceres CLONE 1573011
  misc_feature (43)..(194): Pfam Name: MatE Pfam Description: MatE
  misc_feature (171)..(171): Xaa is any aa, unknown, or other
MEREDACRVALLDAAGGEGGKKQQQLAARVWEESRKLWDIVAPAIFSRVVTYSMNVITQAFAGHLGDLELAAISIANTVVVGFNFGLMLGMASALETLCGQAFGAKKFHMMGVYMQRSWIVLFMCAVLLLPMYFFAEDVLLLTGQPPELAAMAGKVCVWFIPLHFSFAFLXPLQRFLQCQMKYTRNAAARAAAL

SEQ ID NO: 86563 - DNA, 791 bp, Zea mays
  misc_feature: Ceres CLONE 1573014
  misc_feature: Encodes the peptide sequence at SEQ ID NO. 86564
  misc_feature (349)..(349): n is a, c, t, g, unknown, or other
  misc_feature (486)..(486): n is a, c, t, g, unknown, or other
ctggagctcaccgcggtggcggccgctctagactagtggatcccccgggctgcaggaattcgtctcacccctagaaaaatgtccaggtaaaaggaaaaatcgctccatcccctgactatcactggctcactgcccttccacctccaggttccagcggccatggtgaagaagcccaacggtgtcgccaaggccacggcgacctctgctgacgtggcagcccagccatccaaggagaatccgtccacccctgggttggtcaaggcctcgaagtttaagaggagaaaggtcaaggccaaccgtgcgaagcaggcagtcgctgcagcagctattgacgaggtcgcccctgtangtgcaggcactggtgatggcgatgcatctgcatcagcggctttaccgcaaccatccgatgttgccgaggcattacctgtggggcaaacgccaaaatcaaccacttttgctgaggcatcacctgtgggacaaacccanaaacccgccactgatggctgaaggattggtgcccgcaccaaataccaaccacggtgtagcatcagctttcgtcgccaaagccaaaaccagctcaagctaaaggtggaaggcgggagctttcaatttcctgcccgcaaggggcaatgaattgggggggcccaaaaaaaatggggggggggatggggcgggattaaaaaaacccccaaaaaaaaaggggcctttgagggatcaagggggaaagggggggtttttttgagggaaaaaaaggcctctggtgttcccaacaaagggaaaaaaacagggga

SEQ ID NO: 86564 - protein, 115 aa, Zea mays
  misc_feature: Ceres CLONE 1573014
  misc_feature (64)..(64): Xaa is any aa, unknown, or other
  misc_feature (109)..(109): Xaa is any aa, unknown, or other
MVKKPNGVAKATATSADVAAQPSKENPSTPGLVKASKFKRRKVKANRAKQAVAAAAIDEVAPVXAGTGDGDASASAALPQPSDVAEALPVGQTPKSTTFAEASPVGQTXKPATDG

SEQ ID NO: 86565 - DNA, 781 bp, Zea mays
  misc_feature: Ceres CLONE 1573015
  misc_feature: Encodes the peptide sequence at SEQ ID NO. 86566
aaagctggagctcaccgcggtggcggccgctctagaactagtggatcccccgggctgcaggaattcgtctcacccctagaaaaaaacctagtccctccccatcccttaataatggaggtatgttcccacaccaccaccactgctgcggcggcggccgtctgcacctttacccaatccagtcgctcctcttcccggcgattccccgcgtcgtctgtctttgcaagcctcccgccgtccccgcgctctctacgcctcgaccatggcatggtgccgtacctctaccccgccaccatgcccgcgccaaacgggctcctcgctgcacccatcgaacacctggagcgagaaccatcatccatatcaaccgacgaggcccctctcacggcgctgtccccgcgggagctgcagctggtgctcgtctacttcgcggaggaggggcacgacaactactgagagctcgagatcttcgactggctcctgcgcgacaacagcgtcgactgggagaccatggagctcatggccgccatctcctgcagcatggatccagcgcctcgtggaggcctatagaggacattcccgatattaacttcactgctcaggggagatgtactgctttttggctactggcctgggttcataactacgaggaataaagtccccccacacttctactttggaccccccgggtaaaaagggaaccgaatctgttcttaaaattcttcgcaaaacagtgcatctagggagagagggaggaataacgtaaacctggggcgggggtaagggg

SEQ ID NO: 86566 - protein, 112 aa, Zea mays
  misc_feature: Ceres CLONE 1573015
MEVCSHTTTTAAAAAVCTFTQSSRSSSRRFPASSVFASLPPSPRSLRLDHGMVPYLYPATMPAPNGLLAAPIEHLEREPSSISTDEAPLTALSPRELQLVLVYFAEEGHDNY

SEQ ID NO: 86567 - DNA, 764 bp, Zea mays
  misc_feature: Ceres CLONE 1573019
  misc_feature: Encodes the peptide sequence at SEQ ID NO. 86568
aaaagctggagctccccgcggtggcggccgctctagaactagtggatcccccgggctgcaggaattcgtctcacccctagaaaaagccacaccaaagaccaaacttggctcgtgtcgtgtctcagtgtctgccaccgagacaaaaatcgtcgtcagaaatttaacgacgcatattcgtctgactgacccgcccgtgcgccttcctcccgcctccccttccaccaccaagagtgacgacagagagacagacagagagaatggcggcgccagatgcccggccctcgtcagccggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctcctcaacgacaccttctggcgccggcccggcgccggcgccggcgacgacggccccggcccgctgttcgtgtacacgggcaacgagggcgacatcgagtggttcgccaccaacaccggggtcatgttcgacatcgcgcccacgttcggcgccctcctcgtcttcatcgagcacagt

SEQ ID NO: 86568 - protein, 169 aa, Zea mays
  misc_feature: Ceres CLONE 1573019
MAAPDARPSSAGPPPARSLLLPLLLVLLLAAYSLPADSAARPSSNSNPRPAFTPPLLKRHQLRRPSSSSAELVAGPANASTKPFTAHYFPQLLDHFAFTPNASTVFRHKYLLNDTFWRRPGAGAGDDGPGPLFVYTGNEGDIEWFATNTGVMFDIAPTFGALLVFIEHS

SEQ ID NO: 86569 - DNA, 760 bp, Zea mays
  misc_feature: Ceres CLONE 1573020
  misc_feature: Encodes the peptide sequence at SEQ ID NO. 86570
  misc_feature (655)..(655): n is a, c, t, g, unknown, or other
ctggagctcaccgcggtggcggccgctctagaactagtggatcccccgggctgcaggaattcgtctcacccctagaaaaaacctctctgcgccgtgctcagatttgcccccctctgcctgcctgcttctactacctgctgacacggcggtgcgggtcgtgctcggtggacgccagggggctacccctacccgggatccaggatcgtgctgtctgctcgccctctcctgctccttcaatcccatcggagatccgtgctggcgtttcctcccgatgtgttcattttcaagtattttatcgctttgccagaaatcttttttatgatgacttaaaatgtctgtagcatattaatcacaatttttagacttgtgctccgtcactacatatgccagacatatattgaagctcatgcagctcctattctcaaacccagtttcagcgcccaattgtttggtttgaagaaatcaagttcagatgggctccattctaagtgctactagtactacggctaagtctatggatcagcatgaggcatctggaacagatcctaataagagggtgaagatatctacttatgagtatgggtcaaaccccaggataattcccaactcttcctgatgagctctcactccagatcctgggcaaggtcaccacggnatccatttacctttaactttgaagctggttttgcccaagccctgggaagggcagcaatcatccgggctatggaactttcccaagctggaggagaagagccttggc

SEQ ID NO: 86570 - protein, 47 aa, Zea mays
  misc_feature: Ceres CLONE 1573020
MGSILSATSTTAKSMDQHEASGTDPNKRVKISTYEYGSNPRIIPNSS

SEQ ID NO: 86571 - DNA, 795 bp, Zea mays
  misc_feature: Ceres CLONE 1573021
  misc_feature: Encodes the peptide sequence at SEQ ID NO. 86572
acccgcggtggcggccgctctagaactagtggatcccccgggctgcaggaattcgtctcacccctagaaaaacctctctgcgccgtgctcagatttgcccccctctgcctgcctgcttctactacctgctgacacggcggtgcgggtcgtgctcggtggacgccagggggctacccctacccgggatccaggatcgtgctgtctgctcgccctctcctgctccttcaatcccatcggagatccgtgctggcgtttcctcccgatgtgttcattttcaagtattttatcgctttgccagaaatcttttttatgatgacttaaaatgtctgtagcatattaatcacaatttttagacttgtgctccgtcactacatatgccagacatatattgaagctcatgcagctcctattctcaaacccagtttcagcgcccaattgtttggtttgaagaaatcaagttcagatgggctccattctaagtgctactagtactacggctaagtctatggatcagcatgaggcatctggaacagatcctgataaaagggtgaagatatctacttatgagtatggggtcaaacccaagggataattcccacctctttcctgaatgaagctctccactcccagattcctggggcaagggtccaccacgggaattccattttagcccttaaacctttgaaaggcttggggtttggcccgaaagcccttgggaaaagggccaagcccaaattcatttcgggggcttaattgaaaaaccttttttcccccagagcccttgtaagggaagaa

SEQ ID NO: 86572 - protein, 42 aa, Zea mays
  misc_feature: Ceres CLONE 1573021
MGSILSATSTTAKSMDQHEASGTDPDKRVKISTYEYGVKPKG

SEQ ID NO: 86573 - DNA, 952 bp, Zea mays
  misc_feature: Ceres CLONE 1573026
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactggaactcaccgcggtggcggccgctctaaactagtggatcccccgggctgcaggaattcgtctcacccctagaaaaaagaacaaaggagccgccaagacggcaaggcgccaaggcgaccggacaggcctaggcgaagcgggcgcagctcctgccggtggtgggtagtgcccctagcaataaacatcttgcccaaccggctctcgctacgcgcctacgcttcgtcaacaccggaaccgcccccaccccgccccgagcgccaattgcaccgccgctcccggccaaaccggccaagtcaacggcgcatccacttctccttaccatcccggaaggtatcttgcgcccgattccgttgccgatttgcgccatccgccgaccgggaaggctccgcccgggtcttgttgtttttgccggggcggggggctccaggacaaacctggccccccgccttgaattgaaatccggggcggtttggggggcctcccaaggtttgggaattttttcccggcgcgggtttttccccaaaaccctttggggtaacccggggcccggggcgggtccccgggggggggcctttttaaccccccggggggggggcggggggcccccgggggggtttttttatacaaaaaaccccggggccccaaaaaaattttttgggatttttcccccgggggggaaaaaaagagcttttatcccccaaaaactctcttgggaaataggggggggggggcccctccttgggggggggcggaaaaaaataaaaacccgcgt

SEQ ID NO: 86574 - DNA, 798 bp, Zea mays
  misc_feature: Ceres CLONE 1573029
  misc_feature: Encodes the peptide sequence at SEQ ID NO. 86575
aaagctggagctccccgcggtggcggccgctctagaactagtggatcccccgggctgcaggaattcgtctcaccccctaaatagatatgaccctgatcattaaggggtgaaggtcggccagtgagacgatgggggataagcttcttcgtcgagagggatacagcccggatcaccagctaaggcccctaaatgaccgctcagtgattaaggaggtgggggcgctatgacaggctggatgtttgccgtagaagttccaccctttgaagagtgggtatatagctcactgatagagcgcccttgagctgaaaatgaacggggctaagctatctgtcgaagctgtgggatgtcatgaatgcttctgcaggggatgcgtcccctctctcagggaatcaaactcgaaagcgggggtcgacgaaacggacgccagaatgtcggcttgaggaacgcacacattgctgagaattctatggcctgaagacgcaaggttccctccagcatggttcttccagggaaggtgagtctggtcctaagacttcgcctaaaaggcctattcgatggatcacagggaaaatattgccctgtaataccccctttgtttggtaccgtaggggaccgaaggaggcccagggttagccccaaaatgagcggcataaggtttaaagggacatgaaggcgaaccccttgctttctttaaggggtaaccaatgggggtcaaagaaaaaatcccgtcggaccccaaaggtccccaaattaaccaagggcgcctgccaacactcctgaaagttttgacaccccccc

SEQ ID NO: 86575 - protein, 32 aa, Zea mays
  misc_feature: Ceres CLONE 1573029
MGDKLLRREGYSPDHQLRPLNDRSVIKEVGAL

SEQ ID NO: 86576 - DNA, 804 bp, Zea mays
  misc_feature: Ceres CLONE 1573031
  misc_feature: Encodes the peptide sequence at SEQ ID NO. 86577
ctcaccgcggtggcggccgctctagaactagtggatcccccgggctgcaggaattcgtctcacccctagaaaaaacctcacctcactcataccgagcgccagttgccagcacgaagagtaggagtagggatcgaagagtgagtgaaactgaaacacgaggaggagtcatggcgaccccggatgaccgcggcagctggttgctgtacctgtccctagccgccaaatgcgccggcgaccagccttaccgcctcgcgggcttcctggccgtctgcgccgtggccttcgtcgtgacctgcctcctgcactggtgcttcccgggaggcccggcgtgggggaggtggtggtggacgcggcggctcggtgccggtggcggcgcgacggcggcggcggcggcggccctgccggggccgaggggcctgcccgtggtcgggagcatgtggctcatgacgggcctggcgcaccgcaagctcgcggcggcggcggagagcctcggcgccaggcgcctgatggccttctccctcgggggcactagggtggtggtggcctcgcacccggacggggcgcgcgaaatccctcagcagcccggggtttgcgggacccggcccatcaaggaagtccgcgttacggggctccttgtttccaaccggcgcccattcgggtttcgccggccctacagggggcccttaattgggggccccgcgccttcctcccccccgatggcatgtttccataggcaaatctgctttttttttccccacggcggggctaagggggccgggccccgccctattacgggagcagatc

SEQ ID NO: 86577 - protein, 212 aa, Zea mays
  misc_feature: Ceres CLONE 1573031
MATPDDRGSWLLYLSLAAKCAGDQPYRLAGFLAVCAVAFVVTCLLHWCFPGGPAWGRWWWTRRLGAGGGATAAAAAALPGPRGLPVVGSMWLMTGLAHRKLAAAAESLGARRLMAFSLGGTRVVVASHPDGAREIPQQPGVCGTRPIKEVRVTGLLVSNRRPFGFRRPYRGPLIGGPAPSSPPMACFHRQICFFFPHGGAKGAGPRPITGAD

SEQ ID NO: 86578 - DNA, 821 bp, Zea mays
  misc_feature: Ceres CLONE 1573035
  misc_feature: Encodes the peptide sequence at SEQ ID NO. 86579
ctggagctcaccgcggtggcggccgctctagaatagtggatcccccgggctgcaggaattcgtctcacccctagaaaaagccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccaccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggagctgcgtgcgtgctcaatgccctgtgctatgctgaactggcgtctcggttccctgctgtggttggggggacatacttgtacacgtacgcagcgttcaatgagatcaacgccttccttggtcttcactcagttgatgctgggattaccatatccggcgcaacaaggcatttgctccgcagcttaacaaagctactttattcgaattccttgaacccaaaccccgttccttggagggggcaaatttccaaacgggggtaggcccaggggggagggaatttttttggggggggggttgggaacaaattaaaaaaaaaggggccccccggttttttttcccaaaaaaatcctaaaaaggggggaaatctcctccgcgcaaagggggggggcccaaaaaaaaaaaccctccccgccccgggggggaacacacaccttttttatat

SEQ ID NO: 86579 - protein, 176 aa, Zea mays
  misc_feature: Ceres CLONE 1573035
MEEARDHRLSSTAGRPFLSGFCAAALRRKPLGARASAAATATGEGLVRQLGVLDLVLLGIGASIGAGIFVVTGTVARDAGPGVTISFVLAGAACVLNALCYAELASRFPAVVGGTYLYTYAAFNEINAFLGLHSVDAGITISGATRHLLRSLTKLLYSNSLNPNPVPWRGQISKRG

SEQ ID NO: 86580 - DNA, 793 bp, Zea mays
  misc_feature: Ceres CLONE 1573038
  misc_feature: Translation starting site: 163
  misc_feature: SWISSPROT Homolog: EC 1.4.1.2 Glutamate dehydrogenase
  misc_feature (793)..(793): n is a, c, t, g, unknown, or other
ggagctcaccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgttctttgcatgccaaagcgtcctcatccgggcaggggagggttccaggggggattgccgggccttggccccgcgaagggggattttccaagggtggggggggccccctcaaggggggcttttcttgggggcccccgggggaaaaaaccaaaaaggattttttgttccccccccacaacaggggggggggggggggaaaaaaagttttttttcgccccataataaaaaaatacccccccccttgtggggggggtcattttaaaaaaaaaaaacacccgtgagaaaaaaaagactctaaaatgaaaagtaacctcctcccggggggggggggggggggcggcctctgcggcgataaaaaaaaaaaaaaatatttccctgttttcgtttttactttttatacgatgatgattacacgcccctcccn

SEQ ID NO: 86581 - DNA, 783 bp, Zea mays
  misc_feature: Ceres CLONE 1573039
  misc_feature: Encodes the peptide sequence at SEQ ID NO. 86582
  misc_feature (724)..(724): n is a, c, t, g, unknown, or other
aaagctggagctcaccgcggtggcggccgctctagaactagtggatcccccgggctgcaggaattcgtctcacccctagaaaaaacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcacggccccgagngaaaaaaaagaaggaagggcgcccgcccccctcgaacagggtgcgccgcgccgccgccc

SEQ ID NO: 86582 - protein, 208 aa, Zea mays
  misc_feature: Ceres CLONE 1573039
  misc_feature: SWISSPROT Homolog: EC 1.14.13.68 4-hydroxyphenylacetaldehyde oxime monooxygenase
  misc_feature (189)..(189): Xaa is any aa, unknown, or other
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLVTVHLLNASKVRSHGPEXKKRRKGARPPRTGCAAPPP

SEQ ID NO: 86583 - DNA, 791 bp, Zea mays
  misc_feature: Ceres CLONE 1573043
  misc_feature: Translation starting site: 346
  misc_feature: SWISSPROT Homolog: EC 2.7.11.1 Non-specific serine/threonine protein kinase
atagctggagctccccgcggtggcggccgctctagaactagtggatcccccgggctgcaggaattcgtctcacccctagaaaaaaaaaagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcgagctcgtccgcggcggggagctcttctcccgcatcgcgcgcgcggggcgggtccgaggaggacgtggcgcgctgttacttccggcagctcgtcgccgcggtcgacttctgcacgggccgcggggtgttccaccgagacctgaagctcgagaacctgctcctcc

SEQ ID NO: 86584 - DNA, 787 bp, Zea mays
  misc_feature: Ceres CLONE 1573045
  misc_feature: Encodes the peptide sequence at SEQ ID NO. 86585
ctggagctcaccgcggtggcggccgctctagaactagtggatcccccgggctgcaggaattcgtctcacccctagaaaaagaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgtgctgcggcgcggccccagcggcagccgcgcccgccgctgcctcgcggggctgcggggggcggggcctgcggctactgactcccggcgtttcgcgggcggagctcagggccaccccccgggcggatcgccgggcaatggcgccctgcgcccgtcgcgtcacttgtacacgctgcaaggcccaagaaggggcctccaaccaggaatgcctatggatccttctggggagaaacctcctggttccaagaagatgaaacccctcctctttgggggggggggggttttgaaacggcccaatga

SEQ ID NO: 86585 - protein, 115 aa, Zea mays
  misc_feature: Ceres CLONE 1573045
MVEAAAGRRTGTSRRRPSGSGGEHRHLVALAVAARVAMVTTRSVGPAAVAEGDGAGAAVTDAGAAGGGGRCMEDFFDCLLGLLGALGMTCAAARPQRQPRPPLPRGAAGGGACGY

SEQ ID NO: 86586 - DNA, 996 bp, Zea mays
  misc_feature: Ceres CLONE 1573046
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (478)..(478): n is a, c, t, g, unknown, or other
  misc_feature (765)..(765): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctgggactcaccgcggtggcggccgctctagaactagtggatcccccgggctgcaggaattcgtctcacccctagaaaaaaagcatcgacactcgccgcgcaccaccaccaccgctgcggctcacggctacgcagcccgctctcccgacccccccgtgccctcctctttttgctactagcacatagagtttcgcccgaatcgatcgccgactgactcccgctaggttcggcccgatcgccgcttcgtcctcccgggctccgcggggaaccccgcgagatgtctgactggagctcgncggctgcgccgaacgtcctccctttttggcccgcaagcccaggggtgggacctcccctttcaagttcaaaattgggggaaaccctttaaaaggtttttttgggtgtggccccaggggaagcccatttttgaaacggaaaatttatcccgcgcccccagggggaaaagaaattgaaacccggcccttttaaaaatttgggccccccaaaaacttaaaaattttttttttggaaactttaacccccattaaaaggaaaggggggggaaaattttccccccggcccccanggggtggggtgggttgggcccactcgcggggggagaaaaaaaactttccccccgaagaaaaaaaaaaaaaaacccccccccccgggaaaaaactgggttgtcccccccggggggaaaaaaaaatccccccccccccccgggaaaaaaaaaaaaaaaaaccttttttctcgccccccccggggaaaaaacccccccccgcctccagagaaaaccccctcttttttccccggc

SEQ ID NO: 86587 - DNA, 871 bp, Zea mays
  misc_feature: Ceres CLONE 1573050
taagctcaccgcggtggcggccgctctagaactagtggatcccccgggctgcaggaattcgtctcacccctagaaaaactaacttggggcgcttcaaaaacccgcctgattggcaggaaattcttacatacttccgtgggtctgaacttcagaactacttcacacgcatattggaagataacttcaaggtcctgtttttccacttcaggaaattcttacatacttcttgttgactaccactatgctctgggtattttcatatgctctctttggtattgcctgttttctatccctacaacatgtgcaatgatgtgcatatttttacaatgtttgtattacatctgaagttgcaagcaatggatgattacaacactataaagataagaatagttgtcgcttaataaatttgaacagtcatgcatatttgttcccttggattgttgctattacctcagttttataacataccaaagaaccctggatagcacaaccataggggaaaatttccatgtaaagttttttttttaaaggtttaaaattggttcctgaactttcttttgggaacttccttttaatttcccttccagggcaaatctatatcaaaaccccgccaagttatgtttttaaacccacaatttccccaaaaagggctttggttccaaagggggaaaatggttataggaacaaagtttgccttttaaaaccctgaaatgggacccgaagagggggaattttggaaaaaagcctgaaaccctgggggggtgtttggaatccttggaaattataaaccccaagtgtttttttgggcccccaaaagaggttagaggaagaaattctttctctggggggcgggtggaaaactcccccaaat

SEQ ID NO: 86588 - DNA, 778 bp, Zea mays
  misc_feature: Ceres CLONE 1573052
  misc_feature: Translation starting site: 156
  misc_feature: SWISSPROT Homolog: EC 3.1.3.16 Phosphoprotein phosphatase
tggagctccccgcggtggcggccgctctagaactagtggatcccccgggctgcaggaattcgtctcacccctagaaaaagcccccctgcttcctccgcctgcaccctctcacgagcgcccgctcgcccagatctagggttccatccgcgggcaagatgagcagcccccatggcggcctcgacgaccagatcgagcggctcatgcagtgcaagccgctcgctgagcccgaggtaagggctctgtgtgagaaggcaaaggagattctgatggaggaaagcaatgttcagcctgtaaagagtcctgttactatatgcggtgatattcatggacaatttcatgatcttgctgaactcttccgaattggtggaaagtgtccagatacgaactacctgtttatgggagattatgttgaccgtggttactactctgtcgaaactgtcacacttttggtgtctttaaaagtcgatatcctcagaggatcaccattctcagaggaaaccatgaaaagcgacagattactcaagtttatgggttctatgacgaatgcttaagggaatatggaaaccccaatgtctggaaaacttttacgaatctttttgattacttcccccttgactggcattgggcggagtcaaaaaatatttttggtttgccagggggggaattttccccccatcccatttggagacccctccgaaaaaaaattccgggaaacttttcgaaccggggggccaaaaaaaaagttcccccccctgagaaaagggtccccgattgtggt

SEQ ID NO: 86589 - DNA, 768 bp, Zea mays
  misc_feature: Ceres CLONE 1573053
  misc_feature (564)..(564): n is a, c, t, g, unknown, or other
  misc_feature (707)..(707): n is a, c, t, g, unknown, or other
  misc_feature (714)..(714): n is a, c, t, g, unknown, or other
  misc_feature (722)..(722): n is a, c, t, g, unknown, or other
  misc_feature (728)..(728): n is a, c, t, g, unknown, or other
  misc_feature (731)..(731): n is a, c, t, g, unknown, or other
aaagctggagctccccgcggtggcggccgctctagaactagtggatcccccgggctgcaggaattcgtctcacccctagaaaaagcctggttcgcatcgcatacagcgcctcagtccagatcgatcctccctcttcccagatcgggtctagttggacggcagcagccgccgccgcggcatctgtcatattcacgccgcgtgtgctctctctttctgtctccctctctatctgcgacgactgggtgtgataccgcagccgccgccctacgctaggttcccgagccttcgccgatctcttctccggcggaagagcgccccacccagaatcccgcccacctggaagcaatcggaaagggtccccccttttgggggcccctttccccccaaaaaatgttcgggaaaaaaattaaaaacccccggggggggggggggaacccccccccccccgggggggggtttttgggggggattccccccccccccgggggggggggaaaaaaaaaaaaccccctcttggggggggggggggaggggcccccccccctcttttgtgggggggggggntaaatttataacccccccccccccccgggggggtgtcttttccccttctcccttctacctaagagggggagtctgcttttcttcccttctaagaaagggaggggggggggcccgcccctccccctcttattatatatatatanacctctnccctctcnttttgntgncggggtgagagtaaaaataagaaaaagagaggggggg

SEQ ID NO: 86590 - DNA, 853 bp, Zea mays
  misc_feature: Ceres CLONE 1573054
  misc_feature: Encodes the peptide sequence at SEQ ID NO. 86591
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (87)..(87): n is a, c, t, g, unknown, or other
  misc_feature (88)..(88): n is a, c, t, g, unknown, or other
tggagctccccgcggtggcggccgctctagaactagtggatcccccggagctgcaggaattcgtctcacccctagaanannnnnnannaaaaaaaaaaaaaaaaaaaaaacgcgctcaattccactgccaagattcgccactccgtccgttaccttcactcgctcactcacaatgcggcgccatggcgaggtacgcgtgatctttgctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcggtgtcggatgccgccaccgtgctgtacacctacagcaccctcctccacggctactcggcgcggctgacgcgcgcggaggccgcggcgctggagtcgcagcccggcgtgatcgtcgtcaacccggaagtgcggtacaagctggacaccacccggacccccgaagtccctggggctgggacggcacggacccccctgttcccgcagtcggggaccggggaccgaagttcctcttcggggtgcctcgacacccgggctttctgggccggaaaaggccaaaacttacaacaaaccccggggttcgggcccccgtgcccttgcggggcctggaaaggggcaaaatgcgccaaggaccgggaaaacgaactttccaacgcccccctccggtggggaacaaaagaaagactcccatcgcgggcggccgagggttttccttccccggaaccggggctttttagaggggggggccaaaagggggccccccgggggggaaacccg

SEQ ID NO: 86591 - protein, 227 aa, Zea mays
  misc_feature: Ceres CLONE 1573054
  misc_feature (34)..(110): Pfam Name: Subtilisin_N Pfam Description: Subtilisin N-terminal Region
MRRHGEVRVIFAMAAAAAAALLASAAVAGRDGRQTYIVHMSHSAMPDEFAEHEEWYAASLQAVSDAATVLYTYSTLLHGYSARLTRAEAAALESQPGVIVVNPEVRYKLDTTRTPEVPGAGTARTPLFPQSGTGDRSSSSGCLDTRAFWAGKGQNLQQTPGFGPPCPCGAWKGAKCAKDRENELSNAPLRWGTKERLPSRAAEGFPSPEPGLFRGGGQKGAPRGGNP

SEQ ID NO: 86592 - DNA, 782 bp, Zea mays
  misc_feature: Ceres CLONE 1573055
  misc_feature: Encodes the peptide sequence at SEQ ID NO. 86593
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
atagctggagctccccgcggtggcggccgctctctcaacagtggatcccccgggctgcttgttttcgtctcacccctagaaaaagcaccacccaccaacccaccatccccgatcgcccttggagatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaggcctacctcgccgcggaggcctacctgggcgccaccttcgccggccgcgccagcaggctccgcgccgagctcccgggcggcagcgaccgcgtcagcctcgccgtcgacgaccacgtcgaggtcaccgacgccttccgcggcgcccggatgcggtggcgcaagacgcggacgctccgccgcggcaacgtgatcgcctggaacccgcgtgaggaggagcgccgcgcctactgcctcaccttccatcgccgccaccgcgcgctcgtcgagggcgcctacctggcagctcaggcccgctaccgcctacaacggaggggaagcgctactatgactcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 86593 - protein, 190 aa, Zea mays
  misc_feature: Ceres CLONE 1573055
MEMVGGSADAIPGLLSYGWAGLWSTLASLLFLWSMVQDHLPFQLEEQLSALARRALAAVTPYVTITIDEHDADSFGRSEAYLAAEAYLGATFAGRASRLRAELPGGSDRVSLAVDDHVEVTDAFRGARMRWRKTRTLRRGNVIAWNPREEERRAYCLTFHRRHRALVEGAYLAAQARYRLQRRGSATMTR

SEQ ID NO: 86594 - DNA, 799 bp, Zea mays
  misc_feature: Ceres CLONE 1573057
  misc_feature: Encodes the peptide sequence at SEQ ID NO. 86595
  misc_feature (762)..(762): n is a, c, t, g, unknown, or other
  misc_feature (773)..(773): n is a, c, t, g, unknown, or other
caaagctggagctccccgcggtggcggccgctctagaactagtggatcccccgggctgcaggaattcgtctcacccctagaaaagcctctcgccatttttactcgtcggctggtccggccccagcgattcggtttggtgcgcctcgtggtccacgtgcgcgggctttgtgctctctcttccctctgtgtgtgtgtgtgtcagttcatcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctgtcgcggaagcacgtgcgggcgccgctctgcgcggggtgcgccgcgcgcccggccgccgcgcgcgtctcccccaccccgtccccgggcggcgccgacccggcgttcctctgcgcggactgctgcgagggctgcgccgccgcttccgcggcgcgcgtgccggtcgagggcttctcggggtgcccctcggcggccgagctcgccgcgtcatgggggctcgacctccgccgcgcggccgtggccgtgggcgacgacggcgacggcggcgacgacgacgaccccttcctctcggtgctcgactactcgtgctgggggggtgggggattggccgacacgggaactgcgccgacctctacgtgccgtgcgacccaacgcggggtgcccngccccctacgncgggcgcgcgcccgcttcaaggggct

SEQ ID NO: 86595 - protein, 188 aa, Zea mays
  misc_feature: Ceres CLONE 1573057
  misc_feature (11)..(58): Pfam Name: zf-B_box Pfam Description: B-box zinc finger
  misc_feature (177)..(177): Xaa is any aa, unknown, or other
MKSCGGGGADGQQCPCDYCGEAAAALHCRADAARLCVACDRHVHAANALSRKHVRAPLCAGCAARPAAARVSPTPSPGGADPAFLCADCCEGCAAASAARVPVEGFSGCPSAAELAASWGLDLRRAAVAVGDDGDGGDDDDPFLSVLDYSCWGGGGLADTGTAPTSTCRATQRGVPXPLRRARARFKG

SEQ ID NO: 86596 - DNA, 860 bp, Zea mays
  misc_feature: Ceres CLONE 1573058
aaagctggagctccccgcggtggcggccgctctagaactagtggatcccccgggctgcaggaattcgtctcacccctagaaaaagatcttttcctctctcgcgttcccctctcgccttcttcttcctcccccacacccaccggtcgccgcccccgtcgccccgtcctcctcggtccagagacgagggggtccgcgccgttccgacgccacaccgcaaccgcatcacatcacacaccgcctgctcccaccgtccgtccgccctccctcgatcgcgccccccggatcgctggtacctccgcgcgcggctccgacctcatcttcctccatcgactggcatcggcagcggcggcgtgttcccggccagccttcgaaaaggtaaatcaatcgcagacttttgggagctctgttgggggggacccgggggggaaagagccaagttactgcagaggctaacatttcgggttgtcgagtgatggcgcaaaggatcaacttccctgacttcatcggggccgtgggtggcatgaatggtggggtgggacctttgggggggaaattcttttgaaaaaggcccttcttcccaaaaattggggggaggggggccccaaatttttgggggagagccctcaaaaaacttgggaaaacaccctgggtgggggggggggcccccccccctctttgtggggggaaaaaaaaaaaaaccggggggggggctcaaaaaaaggactccccccccccggggggagggtggggggacccccggggccccctaagggcgcccccccccccctggggggaaaaaaaccacacttggggggagagagaaattttttttcccccccccctctcgcgccggggggggg

SEQ ID NO: 86597 - DNA, 814 bp, Zea mays
  misc_feature: Ceres CLONE 1573059
  misc_feature: Encodes the peptide sequence at SEQ ID NO. 86598
aaagctggagctccccgcggtggcggccgctctagaactagtggatcccccgggctgcaggaattcgtctcacccctagaaaaaagcatcactgccgtgtagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatgctcctgctccagaactccgtcgagttcgtgctcgccttcttcggcgcgtccttcctcggcgccgtcaccacagccgccaacccgttctgcacgccgcaggagatccacaagcaattcagcgcctccggcgcgaaggtcgtcgtcacccactccgcctacgtcgccaagctccggcacgacgccttcccgaggatcggcgtggacggcaatgccctcaccgtcctcaccatcgacggcgacgcggccgacaccccggaaggctgcctggcgttctgggagctgctcacgtccggcgacggcgacgcccctccggatgtgtccatctccccggacgaccccgtggcgctaccgttctcgtcgggcaccacgggggctgcca

SEQ ID NO: 86598 - protein, 221 aa, Zea mays
  misc_feature: Ceres CLONE 1573059
  misc_feature: SWISSPROT Homolog: EC 6.2.1.12 4-coumarate--CoA ligase
MITVAAPEAQPQVAAAAVAAPEETVFRSKLPDIDIPTHLPLHDYCFSRAAEAAGAPCLIAAATGRTYTYAETRLLCRKAAACLHGLGVAQGDRVMLLLQNSVEFVLAFFGASFLGAVTTAANPFCTPQEIHKQFSASGAKVVVTHSAYVAKLRHDAFPRIGVDGNALTVLTIDGDAADTPEGCLAFWELLTSGDGDAPPDVSISPDDPVALPFSSGTTGAA

SEQ ID NO: 86599 - DNA, 765 bp, Zea mays
  misc_feature: Ceres CLONE 1573061
  misc_feature: Encodes the peptide sequence at SEQ ID NO. 86600
aaagctggagctccccgcggtggcggccgctctagaactagtggatcccccgggctgcaggaattcgtctcacccctagaaaaatcccgtgcgcttgcggtgcggacgcttcccctccacctccgcacacatctccaactaaccatgccagtctaccgcagtactgccgacttctagcagttgttttataggttagtttcgttgccttgtgtctttgttagtgtatcaaaaccaattcgcgacatcacttaggaaggggaaagcaggggccggaaaaagaagaagagacgggaatggcaagctccgactcaaatcccaccgatgcattcgagtacatgctgcttgagaaggatcctgatctctaccggacggttttctctggtccgagccagacaagtccatggattgacccgagtgtgttaaagctgaagcaccggatagggagaggtccatttggggatgtatggatagcaactcaccaccaaaggacagaggatttcgatcagtaccatgaggttgcggtgaagatgctgcatccaattaaagaggaccagctgcagatcttctcagcgaggttccatgagatcttcagcaaatgtcagggtctgggcaacgtttgtttcttgcatggcatctctacacagaatgggaggatttgtatagctatgaaattctatgaaggatccatcgggaacaagatggctcggcttaaaggtggaaagctccctttgtcagaagtctaagatatggggctgatttggcacg

SEQ ID NO: 86600 - protein, 149 aa, Zea mays
  misc_feature: Ceres CLONE 1573061
MASSDSNPTDAFEYMLLEKDPDLYRTVFSGPSQTSPWIDPSVLKLKHRIGRGPFGDVWIATHHQRTEDFDQYHEVAVKMLHPIKEDQLQIFSARFHEIFSKCQGLGNVCFLHGISTQNGRICIAMKFYEGSIGNKMARLKGGKLPLSEV

SEQ ID NO: 86601 - DNA, 729 bp, Zea mays
  misc_feature: Ceres CLONE 1573062
  misc_feature: Encodes the peptide sequence at SEQ ID NO. 86602
ctggagctcaccgcggtggcggccgctctagactagtggatcccccgggctgcaggaattcgtctcacccctagaaaaacacctctctcgctgcctttatttcctgttggcgacgctctcgccaggtcttcggcggcccgttcggcggcgactagcgcctccgtttgccaggtcttcgtcgtccgtttcgccgtcgactggtgcccagcagccaggtacatctggaagaatgggggtttaccttagcacaccgaaaactgacaaggtatccgaagatggggaaaacgataaacttaaattcggactttcatctatgcaagggtggcgtgcaactatggaagacgctcactcggctttgctagatcttgacaatgacactgcattctttggtgtttttgatggacatggaggaaaagtagttgccaaattctgtgcaaaatatctacacagagaagttctccataccgaagcctatgctgctggtgacctgggtgctgctgtccacagagcttacttaagaatggatgaaatgatgcggggtcaaagaggatggcgggaactccaagcacttggagataagataaatcagttcactggcataatagaaggccttgatttggtccccctaaagcaagtgatttcaaatgatagacattgatgaattgggcttttcgagggaggtactttgttggaaactgggcatgggttcccattaatttctaatacctc

SEQ ID NO: 86602 - protein, 142 aa, Zea mays
  misc_feature: Ceres CLONE 1573062
  misc_feature: SWISSPROT Homolog: EC 3.1.3.16 Phosphoprotein phosphatase
MGVYLSTPKTDKVSEDGENDKLKFGLSSMQGWRATMEDAHSALLDLDNDTAFFGVFDGHGGKVVAKFCAKYLHREVLHTEAYAAGDLGAAVHRAYLRMDEMMRGQRGWRELQALGDKINQFTGIIEGLDLVPLKQVISNDRH

SEQ ID NO: 86603 - DNA, 771 bp, Zea mays
  misc_feature: Ceres CLONE 1573063
  misc_feature: Encodes the peptide sequence at SEQ ID NO. 86604
  misc_feature (611)..(611): n is a, c, t, g, unknown, or other
aaagctggagctcaccgcggtggcggccgctctagaactagtggatcccccgggctgcaggaattcgtctcacccctagaaaaagcgtcggcaccttgcgcacttgcacttggttggaggtcctctaccttttccatcgctctgctctgctctgcttcgcgtctccgtccgccgcggcaaaagcaaaacacagccatggaggggtacgaccgcgagttctggcagttcagcgaccagctgcgcctgcagacgaccgccttctctggcctctccctcggcgactccatctggtctccggccaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgccttcggcggcagcaaggccggccgctacaacaacctcccatccgagaaggccgcgcccgtctacaaccacagcggcgccacgatcaacggcggctacgccaggagcgacaacgccgggcctggcggcgttcaacaagatggggagctacttccacaacagtaacggcaacngcggcggcggcggggaaggtgaagagctacttcaacaagtccgcccggacgggcggcgagcaacaacagccacggggcacgccggcgggcgcaataaagggcggcggcggcgggaagcacgcagaacaaagggcaaaccgggcgggccccgttggcggcc

SEQ ID NO: 86604 - protein, 135 aa, Zea mays
  misc_feature: Ceres CLONE 1573063
MEGYDREFWQFSDQLRLQTTAFSGLSLGDSIWSPATGAGGRRNNNTDLLAASASAADAGKHNGVGLSLNDGGPGLIGSGKLAFGGSKAGRYNNLPSEKAAPVYNHSGATINGGYARSDNAGPGGVQQDGELLPQQ

SEQ ID NO: 86605 - DNA, 783 bp, Zea mays
  misc_feature: Ceres CLONE 1573064
  misc_feature: Encodes the peptide sequence at SEQ ID NO. 86606
  misc_feature (674)..(674): n is a, c, t, g, unknown, or other
  misc_feature (756)..(756): n is a, c, t, g, unknown, or other
aaagctggagctccccgcggtggcggccgctctagaactagtggatcccccgggctgcaggaattcgtctcacccctagaaaaaagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcagggacagttccccaagcgttgggccatcgtcttcctctgcttctccgcatttctactctgcaacatggaccgcgtaaatatgagcattgctattctgcctatgtccgcagagtttggttggaacccacagactgttggtctcatccagtcatctttcttctggggctacctcctaactcagatagctgggaggatatgggcagatactngttggaggaaagactgtccttggttttgggtgtggggtttggttggtcccatagctacagctccttactcctgttgcagcancatcttggcttgccaatttcttcttgt

SEQ ID NO: 86606 - protein, 200 aa, Zea mays
  misc_feature: Ceres CLONE 1573064
  misc_feature (165)..(165): Xaa is any aa, unknown, or other
  misc_feature (192)..(192): Xaa is any aa, unknown, or other
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQGQFPKRWAIVFLCFSAFLLCNMDRVNMSIAILPMSAEFGWNPQTVGLIQSSFFWGYLLTQIAGRIWADTXWRKDCPWFWVWGLVGPIATAPYSCCSXILACQFLL

SEQ ID NO: 86607 - DNA, 806 bp, Zea mays
  misc_feature: Ceres CLONE 1573065
  misc_feature: Translation starting site: 187
ctggagctccccgcggtggcggccgctctagaatagtggatcccccgggctgcaggaattcgtctcacccctagaaaaaaaacactgatcctctgttagttctcccggcgccgcctatcccctcccgttctccgtcaccgacaatcggatcccgtactccgccacatatgctgtagacgagaagaaatggccggcaaagttgatgggccggccatcggcatcgatcctcatcacacacgtactcttgcgccggtgtgtggcagcaccaccgtggcgagatcagaccccaccaccacggtaaccacaccactgcctcattccttctcttcgccgactccgtacgactcattggagatgcggccaagaactaggttcgcctgtgaacacatcaactgcggctgtgatggctactctgccattgcctagaagttcagtgatccctgtctccacaatgataacaaacggtgccgcttccatgtcatcggtagaccccgtgagaagcgaatgatagctgtgcaccatgctgccgatgagaacattttggagccgaagagatctccatcatggtgtctacttcgatgcgtgacatcgctagaacttaccttggcagcacgatcaagaatagtcgtgtatcggtcactagcgtacttcacgactctcatacgcagtgcacgaacgatgctgggcctgattgctgggcctcaatgctgctgcgtatcctgccatgtacccacctccctgctgctggctgccaaataggaacttgcaccaggatggcatcccagccgctaagtggaagaaagaat

SEQ ID NO: 86608 - DNA, 739 bp, Zea mays
  misc_feature: Ceres CLONE 1573067
aaagctggagctccccgcggtggcggccgctctagaactagtggatcccccgggctgcaggaattcgtctcacccctagaaaaagcaaaccctaatccccatcccccagccgacagccgccgagcaaaccggctcctccggtcggtcatccactcatcctcatcccctggcccctgcccatccgatccgatcggtcatcccctacccctacctgatcggatcccctgctcttccgccgagcaccaccaggcagcaggctgcagccgtcgagcaccagcaggagcacggccaggaggacgacgcccgcatcctgcctcttctctgctgctggagcttctgctgccaggagcacggccagaaggacgacgcccctgctgctgccggtgagcggtgatctgctgcgcccccatcctgcctcttctcctccctctcggcctcgcctcgatctgctgctggtaatgtcctttatgaggtactacaagattagaaaatagaaaggtgtcgactgtgactcttgataattgcaccaccaatgatagtattatgagttctatgcaagataagttgcccctcttatccctcatgctagatggtaaattgttacacatagcgttgtgtggcacacatcattaatcttattgtgaaagatggaatgaccgttatggataaaggtattaaaaaggtacgcaatagtgttgcatttttggtgtgccacgccaaaaagacatgagcgttcgca

SEQ ID NO: 86609 - DNA, 844 bp, Zea mays
  misc_feature: Ceres CLONE 1573068
  misc_feature (225)..(225): n is a, c, t, g, unknown, or other
  misc_feature (226)..(226): n is a, c, t, g, unknown, or other
  misc_feature (244)..(244): n is a, c, t, g, unknown, or other
  misc_feature (285)..(285): n is a, c, t, g, unknown, or other
  misc_feature (286)..(286): n is a, c, t, g, unknown, or other
ctgaagctcaccgcggtggcggccgctctagaactagtggatcccccgggctgcaggaattcgtctcacccctagaaaaattcgcgagacctctcctgtccggatcgaggttcatggtttacatatgcgcgtttgtttactgatgcataccacgaccacctgatccgtatgtcaggacagatctcctgctttaatcgagtccagttcatgtatgaactttccctnntttcctggcacgttgctnagatgtaaaagggtgttccgggattttaaaaagaaaccccnncccccaaccggccatttcccccattggttttttggaaacccaagaggtggtttaattgggtagaaagagtttcagagttgactattagggtgtgtaggagaatgatgtatggctttaaattgagtaacatataaaatgaacaataagtagaatcgggtgtggtgtatttagttgtggggtggtaatattatggggagcatgttcggaggttgagggcgaatgctgagtgtgtgtggctacgaaggggtagtctagagagcctggtgtagtgatggtttttggtgtgttgtgtagtattcgttggggtgggatatataatgattgggtgtgtgggttggggtttgtgtgagagagaaggagggggtggggaggggagggggggttgaggggggtgggggggtggtgttgtgggatagtggctctactggttagacgtttatgtatgtttcttatataggcaggcagggttagctgaaagaacagtttgccagcttttataatttatttggagtgacgctcacagcgggcgtagggtttgaccgtgaagggggatgagtg

SEQ ID NO: 86610 - DNA, 759 bp, Zea mays
  misc_feature: Ceres CLONE 1573069
  misc_feature: Encodes the peptide sequence at SEQ ID NO. 86611
ctggagctcaccgcggtggcggccgctctagactagtggatcccccgggctgcaggaattcgtctcacccctagaaaaaggaccaaatccgatctcgtggccacggccagaacacacctcctcacgtccacctgacctcttgctcctccccaataatgcccagtgcggcagtgcctgccaccgtctaagcccaccccaagtctccgccgtcaacccgtcctccccatggccgccgccgccgccatctctctatccttccactttcgtttccgcccgccccttccatctccacgtacccccacgcgccacgctcccttttccttgttctccccttcccttcttgccccctgccgcctccgcgtcgctcccggccgcccctcaccgtccccgtggcgccccgacgtgcgggcgcgcgctggaagcaccatcggggcgccgcctgcgcttgtgcgcccaggcggagccgtggagacggaccgcctcccctccgacgtgcgggaccgggccatggaggcggtcgaccacttcggcggtcgcgtcaccataggagacgtcgcttctcgcgctgggctgcagctcgcgcaggcggagcgcgcgctccaagcactcgccgccgacactgtaggccttcctggaggtatcggaggacgggggagttgctatacgtcttcccaaaggactacagggccaaagctggctgggcaaatcgttttagggattgcgggttcgagccctcctggtttgacaaaagccaaggca

SEQ ID NO: 86611 - protein, 84 aa, Zea mays
  misc_feature: Ceres CLONE 1573069
MEAVDHFGGRVTIGDVASRAGLQLAQAERALQALAADTVGLPGGIGGRGSCYTSSQRTTGPKLAGQIVLGIAGSSPPGLTKAKA

SEQ ID NO: 86612 - DNA, 714 bp, Zea mays
  misc_feature: Ceres CLONE 1573070
ctggagctcaccgcggtggcggccgctctagaactagtggatcccccgggctgcaggaattcgtctcacccctagaaaaagcagaagaggtcctactgaatggcgatgttgcaagtacatctgggaaatccattgcaagcttacaggtggaagcatctgatttggcaaacttcctaaccatggtatcggaatgggaggttacctgaggttcacaaactcttctaagatctgtcattatcagacaaacaagagctgtgcttctctgttgtctcattgctctaggagaagctcatagcttctcctgaaatgcagatgtctgcacaaagtacatcagctcacccaggatggaagaaggtcggttgatgcacctttgctgatgtcgctttcagccgtcacacaagcaatggcatctctgtgcgtatcgcttcgtccagggccgcatgaatcgaccttggctggcctgtgggcatatgcatactaggatgcacccaaacaaacgtgctacaagaaagtgacgactagtcgaaccaggcggtattactggaatcccttattagcttcgaggctttatgcagggtaaagccatgaaccagccccctggaaaggcgtttttgggtggaatacctcccgcccgaagtttgcccctcccccaaaccctttggctaacccttccccttgggccgtaccccccaaggggggggaaatggaaccttc

SEQ ID NO: 86613 - DNA, 986 bp, Zea mays
  misc_feature: Ceres CLONE 1573073
  misc_feature: Encodes the peptide sequence at SEQ ID NO. 86614
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (191)..(191): n is a, c, t, g, unknown, or other
  misc_feature (485)..(485): n is a, c, t, g, unknown, or other
  misc_feature (486)..(486): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcaaagctggagctcaccncggtggcggccgctctagaactagtggatcccccgggctgcaggaattcgtctcacccctagaaaaacctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttgacccaatcccctctgcctctcacccccatcgcctcccacctctcatctattcctcgnncgctactgcccccgctcctcggcttcagatcgggctctcaagcgagctctaagcccgccgcgtccgccggatctgggccgtgcttaaaccgcttccccctccttcctctcgctttgccggccaggctccgcccttccgcctttctcgtggccccggggccgggccctaaagttaaccccagaaggccctgggaaaatcccccttcccatatttttcccctcccacccaatttgcggggggggttcgggttcctccggggccccgcttccccccttttgggggtagttggggccgttttcccttgtgggcctcaaaaaaaccacccggttggccaaacccgggaaagcttcccccccttttacccccccccgggtttttgggggggggttttccccaataagaaaaatccctctctggggttcaaccgcgcgaaaaataacccctttttttttttctcccgggggcgggggttttttttcaaaaaaacccgggactcccgc

SEQ ID NO: 86614 - protein, 34 aa, Zea mays
  misc_feature: Ceres CLONE 1573073
MESLRLAVTHRPALPLPTSHSHLRRRHLHLHLHS

SEQ ID NO: 86615 - DNA, 782 bp, Zea mays
  misc_feature: Ceres CLONE 1573074
  misc_feature: Translation starting site: 253
ctggagctcaccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatccctacgtgtccctcgccgcgctcgccaacaggtacggcccggacctgatgctgctccgcttcggcgccgtgcccaaccgtggtgggtcttcgtcccccgcgcgttcgccaaaggccgtggctccgcaccttacgaaccaaggttgtttttccttcccggcccgggggctttccctgggtgtcccaaaaaatccatccatggttaacggggggccacaccgaaactcgttgggttttcgggggcccctaaagggggga

SEQ ID NO: 86616 - DNA, 763 bp, Zea mays
  misc_feature: Ceres CLONE 1573075
  misc_feature: Encodes the peptide sequence at SEQ ID NO. 86617
  misc_feature (740)..(740): n is a, c, t, g, unknown, or other
ctggagctcaccgcggtggcggccgctctagaactagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaaagtcggctggaaagaaccgtccgaagacgactggatcggcgtcttctctccgtctgaatttcactcggtcggctacttgtcccgaccccatggccagcagaaaaacccttatctctgcacagcacccattcaaagtttcaggtcggccaaataactctgggaaactaattcttccgggggggcaagggggagaattccgggtttgaggtttattaaacaaggggttccggaatttttcctttgggccctttttttcccggggggggccttagaaaacccccaaggggtgattttcccgggggttgcggagaacccccatttttttgtgttaaaaaaaccccccaagggggcccccccgggtttttccccccccccccttggggngcacagggggggccgcccccccc

SEQ ID NO: 86617 - protein, 119 aa, Zea mays
  misc_feature: Ceres CLONE 1573075
MAVALLAALVASAAMLAGTASASPAEGIQPLSKIAVHRATVEMQPSAYVRATPSLLGEQGEDTEWVTVKVGWKEPSEDDWIGVFSPSEFHSVGYLSRPHGQQKNPYLCTAPIQSFRSAK

SEQ ID NO: 86618 - DNA, 775 bp, Zea mays
  misc_feature: Ceres CLONE 1573076
  misc_feature: Encodes the peptide sequence at SEQ ID NO. 86619
  misc_feature (658)..(658): n is a, c, t, g, unknown, or other
  misc_feature (661)..(661): n is a, c, t, g, unknown, or other
  misc_feature (696)..(696): n is a, c, t, g, unknown, or other
  misc_feature (720)..(720): n is a, c, t, g, unknown, or other
ctggagctcaccgcggtggcggccgctctagaactagtggatcccccgggctgcaggaattcgtctcacccctagaaaaaagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggccggcgtcggagtcggctcgctgggaagtgggcgccgccgccgccgacacctccaacgcctccaggcagggattagatttgggcgcgatgtcccatggccaagggaggggagcgaggccnaangcgctcgaaaaagacggcggcaaaggcttcttcanccttcggggcccaggttctttggntcaaggcgttccttgccgctcttcctttcctcccggggtccgtcagaagaatgcc

SEQ ID NO: 86619 - protein, 151 aa, Zea mays
  misc_feature: Ceres CLONE 1573076
  misc_feature (113)..(113): Xaa is any aa, unknown, or other
  misc_feature (114)..(114): Xaa is any aa, unknown, or other
  misc_feature (125)..(125): Xaa is any aa, unknown, or other
MGMDAGGGKLPYSYAGQQDGGKLVKSVSRVEPRRFGLGLVAGFLVVTCAYFSTAKFDAIQIAMTSRPVSSNAAGVGVGSLGSGRRRRRHLQRLQAGIRFGRDVPWPREGSEAXXARKRRRQRLLXPSGPRFFGSRRSLPLFLSSRGPSEEC

SEQ ID NO: 86620 - DNA, 818 bp, Zea mays
  misc_feature: Ceres CLONE 1573078
  misc_feature: Encodes the peptide sequence at SEQ ID NO. 86621
gtccccgcggtggggggcgttctagaatagtggatcccccgggctgcaggaattcgtctcacccctagaaaaaaggaccccgctggcaccttatgagaaatcagagagctagcatggcaaatggcccattcgttgctctagaaacagcctcggcatatacattcccatgaaggtccaccgatcccgtggaagatctggataagactgcaagcgttgatgggaaaggtgccagtagggctgctgatgacgatacttttttccaccattccaccccttttcaccaccctcgtaaatcagatcctttctttacctctgaattcaatggtcatgcacaggacactaaaccgcctagcgctagtccgtgattcgagtcctctacaccattcaatggatacaaacccagcgcgtcgatcttctatggaatactttgataatgcaacgccctagtcactgtctgcatagtattctgacattcgtggtaatgatacagaggatcagtcgacaagatctactgaatcctgaagatgatatatggcttaccgttgtcgagattcaccttttcacagaaccaactattgctgcaccactctccagatcacccacctcttcgcaaacgaaagccatctgacatcaatgcaaagggagaatgggcatgggtcgtcagttctaccccaaaataaaaaccattacaccggatgtgccccaaacaaccccgaagggtttgcttctaatagaatgcaccctgagaaagggctttttccaaggggggcaaaacccttcaaattgccccgtggcttatatggccaaacaccttgttt

SEQ ID NO: 86621 - protein, 41 aa, Zea mays
  misc_feature: Ceres CLONE 1573078
MVMHRTLNRLALVRDSSPLHHSMDTNPARRSSMEYFDNATP

SEQ ID NO: 86622 - DNA, 759 bp, Zea mays
  misc_feature: Ceres CLONE 1573086
  misc_feature: Encodes the peptide sequence at SEQ ID NO. 86623
  misc_feature (574)..(574): n is a, c, t, g, unknown, or other
aaagctggagctcaccgcggtggcggccgctctagaatagtggatcccccgggctgcaggaattcgtctcacccctagaaaaagtagtcgttcagtcaggcgaggcgagcgtcgattgaagacgatgtgggagtcagagagcgattgccatgccggtgagcgcgggctcgtacccgtcggcggcggcggctcctcgggccggtacgaggcggcgctcaagaacgacggctttgttcgaagagaccagtcctggtatgtaaacagcgatattcccagcgatttgcttgtcaaagttggagatgttagcttccaccttcacaagtacccgatgatctcccggagcgggcggatgagccgcgtgatctacgagacggcggcggcgcccccggactctgacacggcggcggtggtggtggagctggacgacgtcccgggcggcgcggactcgttcgagctggcggcgcggttctgctacggcatggcggtggacctgacggcgggcaacatctcggggctgcgctgcgccgccgagtacctggagatgacggaggagctgggaggaggcaacctcatnctcaagacgggagcggtcctcagctacgtggtgctgtcgtcgtggcgggactccatcgtggtgctcaagacctgcgaaggggctctccgccctgggccgagaaccctggcagatcgtgcgcccgcttgcagcgaagtccattcgcccggggaagggcctgcccccaaccccgccggggggcgtgg

SEQ ID NO: 86623 - protein, 211 aa, Zea mays
  misc_feature: Ceres CLONE 1573086
  misc_feature (150)..(150): Xaa is any aa, unknown, or other
MWESESDCHAGERGLVPVGGGGSSGRYEAALKNDGFVRRDQSWYVNSDIPSDLLVKVGDVSFHLHKYPMISRSGRMSRVIYETAAAPPDSDTAAVVVELDDVPGGADSFELAARFCYGMAVDLTAGNISGLRCAAEYLEMTEELGGGNLXLKTGAVLSYVVLSSWRDSIVVLKTCEGALRPGPRTLADRAPACSEVHSPGEGPAPNPAGGR

SEQ ID NO: 86624 - DNA, 789 bp, Zea mays
  misc_feature: Ceres CLONE 1573089
  misc_feature: Encodes the peptide sequence at SEQ ID NO. 86625
  misc_feature (765)..(765): n is a, c, t, g, unknown, or other
ctggagctccccgcggtggcggccgctctagaactagtggatcccccgggctgcaggaattcgtctcacccctagaaaaagttacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccagactgaatgacaagaatgttctctatatcatcctcagtatgtgtgaagaaatagtctgtaactacacatacctttcattgcaattaccaagaactggaaatggacgatgataatgggcttgagcttagtttgggcctatctttgggcgggtcatcagggaaggccaaggctagagatgcacctctagaaccaaaagcagaaccccaagtggaagaaagcagtagcaaaggtggtttacaaactcctgatgctccttctgggaaattttatcaaaagagcgctgataaccatgaacaaaatagtaaacagaggcacagccctgttgcaccacaatttgggaacttctggggacaaccagggaattcctccggtccagtggtagatggttctgttgaaccggtgagtcatcagcctcagctttccagttatcaagatggaaggatgccaattaacagtggaaataattctgaggagcagaagccagtttctggtaaccacaangtgccttctgaagagatgaactta

SEQ ID NO: 86625 - protein, 142 aa, Zea mays
  misc_feature: Ceres CLONE 1573089
  misc_feature (134)..(134): Xaa is any aa, unknown, or other
MDDDNGLELSLGLSLGGSSGKAKARDAPLEPKAEPQVEESSSKGGLQTPDAPSGKFYQKSADNHEQNSKQRHSPVAPQFGNFWGQPGNSSGPVVDGSVEPVSHQPQLSSYQDGRMPINSGNNSEEQKPVSGNHXVPSEEMNL

SEQ ID NO: 86626 - DNA, 756 bp, Zea mays
  misc_feature: Ceres CLONE 1573092
  misc_feature: Encodes the peptide sequence at SEQ ID NO. 86627
ctcaccgcggtggcggccgctctagaactagtggatcccccgggctgcaggaattcgtctcacccctagaaaaagccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcgacggcggggtcggctcgagctccaacccagtggttccagctattggagaatctattaatgctcccgaaaaggtagttggatttataatatctggggaagagaatgatacatgtacacaagaggttggcaatgtttcagaatgccactcttcagaacagggggattccggtttgcctgtagataattttggctcagttgggtcatatcctgagagacctaaaatggtgggatcccttcaggctgaccatttgggctcaggttctactggactgggtaatgggactcagatagctgccaggaagaatcagaccgtgaatgctaatcaactactgaaattccagtatgatccctatttctcgggcacagccccagaggccctagaacatatcttcccgagaagaccaaagaaagataaaaccttccaaacagggatcttggtcatccaagcaaaaa

SEQ ID NO: 86627 - protein, 203 aa, Zea mays
  misc_feature: Ceres CLONE 1573092
MSISPHERTGGAYYPRPHNPSPSPQHGSDRRRHGRRSPPASVSPPGAAAEASDGGVGSSSNPVVPAIGESINAPEKVVGFIISGEENDTCTQEVGNVSECHSSEQGDSGLPVDNFGSVGSYPERPKMVGSLQADHLGSGSTGLGNGTQIAARKNQTVNANQLLKFQYDPYFSGTAPEALEHIFPRRPKKDKTFQTGILVIQAK

SEQ ID NO: 86628 - DNA, 769 bp, Zea mays
  misc_feature: Ceres CLONE 1573094
  misc_feature: Encodes the peptide sequence at SEQ ID NO. 86629
ctcaccgcggtggcggccgctctagaactagtggatcccccgggctgcaggaattcgtctcacccctagaaaaaaaaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctcctccatcgccaccaccgccgtcgcccaccagcacgccgtgccctccgccaccgtccagctccggcggcaagtgccccaagaacgcgctgaaactgggcgtgtgcgccaacgtgctgggcctcgtcaaggtgtccatcggcaaggtgcccaccgactcgtgctgcccgctgctggacggcctcgccgacctggaggccgccgtctgcctctgcaccgcgctcaaggccaacgtgctcggcatcaacctcgacgtccccgtcaagctcaccctgctcctcaactactgcggcaagagcgtccctcaaggcttcctgtgcgcctaatatatactagtggctagttcgtcactagcttcagttgccatgcatatttgtgattcttcttctttccttctagttcaccactgttatgtacgtgcctccctccgatcccggatgtttttcctttgggaattggccttctccttctaacctcttctccctaaacttg

SEQ ID NO: 86629 - protein, 145 aa, Zea mays
  misc_feature: Ceres CLONE 1573094
  misc_feature (63)..(144): Pfam Name: Tryp_alpha_amyl Pfam Description: Protease inhibitor/seed storage/LTP family
MASVTRFPAVALVLLLAASAFLASEVAACGGCPKPTPPPPSPPPPSPTSTPCPPPPSSSGGKCPKNALKLGVCANVLGLVKVSIGKVPTDSCCPLLDGLADLEAAVCLCTALKANVLGINLDVPVKLTLLLNYCGKSVPQGFLCA

SEQ ID NO: 86630 - DNA, 779 bp, Zea mays
  misc_feature: Ceres CLONE 1573098
  misc_feature: Encodes the peptide sequence at SEQ ID NO. 86631
gagctcaccgcggtggcggccgctctagactagtggatcccccgggctgcaggaattcgtctcacccctagaaaaagcttgcgctctgtttcggtgtttcctgtttcggtgtttcctgtctctggtggcgacgactgggcggccgacgctgccaccgccctacgccaggtgaccaggtctttcgtattcgggatcttcgccggcgtcgagcacccggccattggcggaaatttgatgagttagagcttattactggtctgatactcctatacgatgtcactgaaacttccaattccgcaagggctttccttcttaagaagtgttggatggtttgaggaccggaaggttgattcagcagccaaacagcagttatccccaacgttgaaactccagacagataaggagacgtacagacctggtgattcagtcactgtgactatcgaaatctgtagcccagctagtttgaaggatgatgttgggcaggcagtgtcaggcgaggatgccccctcgctgttgttagatgtgctatcattttgaacttaaagggattgagaagctggatactccaatggttctctgttccctaagcccctacccagggtctaaacaaagggcgaagtggaacatatggtttctgggattgttcgggcaccaatcactggggctctaaaagtaataaattggggccaggggcggaacaaaaaccgtaccattgccacgtggtgggaggctcccaaaggacctttggcccgccattctttataagggggcatccagta

SEQ ID NO: 86631 - protein, 87 aa, Zea mays
  misc_feature: Ceres CLONE 1573098
MSLKLPIPQGLSFLRSVGWFEDRKVDSAAKQQLSPTLKLQTDKETYRPGDSVTVTIEICSPASLKDDVGQAVSGEDAPSLLLDVLSF

SEQ ID NO: 86632 - DNA, 765 bp, Zea mays
  misc_feature: Ceres CLONE 1573100
  misc_feature: Encodes the peptide sequence at SEQ ID NO. 86633
  misc_feature (724)..(724): n is a, c, t, g, unknown, or other
ctggagctccccgcggtggcggccgctctagaactagtggatcccccgggctgcaggaattcgtctcacccctagaaaaaaggccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagttcaagatctgttccacagatcacgcgtgcgcgctcgcgaatcgggggttccacacatagcttcgtcgttgtgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtataggatttcttttctgacactgcgattcttaccaatccccctggcctgctgctttcctgacaatagacctgatccccagtcttgctccctgcagtcctccctcctgcatctccagcgttgtgttctgactcacctgcaccaatggctgttctatctgctgctggtgctcccccggcctcagctatcggggtttgagggctatgnagaagcgccttgaggatcccattcttctgaaggaacatgtc

SEQ ID NO: 86633 - protein, 50 aa, Zea mays; identical to SEQ ID NO: 23071
  misc_feature: Ceres CLONE 1573100
  misc_feature (1)..(50): Pfam Name: AdoMetDC_leader Pfam Description: S-adenosyl-l-methionine decarboxylase leader peptide

SEQ ID NO: 86634 - DNA, 901 bp, Zea mays
  misc_feature: Ceres CLONE 1573101
  misc_feature (376)..(376): n is a, c, t, g, unknown, or other
  misc_feature (731)..(731): n is a, c, t, g, unknown, or other
aagctggagctccccgcggtggcggccgctctagaactagtggatcccccgggctgcaggaattcgtctcacccctagaaaaatgcccgccccactgctgcccattcctctcatcccagcgaacgaccctccagcacgccatccgcttagccgccccggagcattgccatcgtcgccgccaccttctatcccagtgtggagcgggagagaacccgtctgcactcagaagctggtttaatccggtgggagcacaagtcgtgtctaaaatattcagattgctaagatgttgggtcatggtctagtaactgatccctcaagaaccttacgatgtccagttaattcaagggtataaagtgcacccttggggcttgtttcntccctgaatttccacaggggatgctaggggaaagaacaaaatattctattgtggatagacacgccaaagtataatacctctttcctggtatgcccccagaataggcccagaatcccccccactaagcaacctgcatcaattcggggggaatatgggccgaattccttcaaactccttatcttttcccccgaaaatgcctgtgtaaaaaagaaccccatgatccacgcggtcctcctggaaatccagagcgggggcaaagccctcccggaaaaaacaaaaaaattccccaagcctggcttaagaaaacttgacccggaataaaggccaaaggtttggaagggcccaacaaaagccncaagttggtttaatgggcaaattggaaagtcctgcgcccaatgaaaaaggggacttttccttggcgcccaaaggtttcctttctcgaaaaggggaaaaaacacccgcaaataatgcgaatccccccaaagaaaaaaaactttttatgggggaaacccttacccaaaggcc

SEQ ID NO: 86635 - DNA, 1090 bp, Zea mays
  misc_feature: Ceres CLONE 1573105
  misc_feature (5)..(5): n is a, c, t, g, unknown, or other
  misc_feature (12)..(12): n is a, c, t, g, unknown, or other
  misc_feature (16)..(16): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (94)..(94): n is a, c, t, g, unknown, or other
ggggngggggtntttnattgataaagaagatggtaagggagccacagggatggggaggaaaatggggngnnnnnnaactaactgggactccccncggtggcggccgctctagaactagtggatcccccgggctgcaggaattcgtctcacccctagaaaaaactcagctcacccaactgctggagtggtagtggttgcttcctctctcttctcacgtcaccatgatcgataagactagctagaatataggtggctggcagtggtagtggcagcgctatcctatatagcgccccccggccggtgtgctcgcctcgggagctagccttggaagaacaagcagagagcagacacaccgttgcgtacagggaggaggagtgcttcttcgttcgtcgttgcccaaatcaccagcactcatttgtaattggaccagagcggggccaaacactccccgccggccggccgacctctgttgggtgggggcggcagcaccagctctcaactgctcaagcaaaccaattaaagcagccaccaatctgtcacacacacagggcggaaccggaaccgagccaatgtattacttcgtcggccgggcctgaggagacagcgcggtgaagcacacgccagaagcagggagcccacttcctttttggcaaattggcaaccttgcgggtcatgggagggatttccaaccagggcacggggccgggttccattcttgtcaggggaacggcccctgccaacttggattgggtgcgtatccgggccggggttcttcccactgggtcgccccttagacttcccattcgattccttcggacagcccgtggggcgccccccccttgaaaaactttggcctgtggcttgcgatctcgcgcgaccatattcttttcctttaggcccgacaccccccccagggtttgggaaacggtaaacaacccccgtgccctgccttggtcggtaatatgataaacggaaccaacccgccacatgaaaggggtgttctcccgagagccccccggagttcctgtaaccgaaagtctctcccccccggacggggggtaacccccctctataaaaggggataggtccc

SEQ ID NO: 86636 - DNA, 1098 bp, Zea mays
  misc_feature: Ceres CLONE 1573109
  misc_feature (64)..(64): n is a, c, t, g, unknown, or other
tttttgttttttgttttttgggggggggaggagggtggggtgggtcacgggcttgggggggttnataaaactgtttgttggcaaactggagctccccgcggtggcggccgctctagaactagtggatcccccgggctgcaggaattcgtctcacccctagaaaaagtgctttcttagaggtgggttggcttctcctccccctcccgttcgggttctggttcatcgagttctccggggttcaggttcgtgtggtgagcggatcgagatggcggctctctgatgtttgagtaccggctgcttcgtcggaccgccctcgcctgggtccacgggactacctctccgctccacaacagccgttcatatacccctacggaaggagggtccctcccaagtcccatggaatacttgccctccgattcccgggaaataccccccaaaaatggttccccccagggtggtttttttccaccgtttatatgtgtgaaaccggttttttttgcctcacccctgttataaggaaaaaagagctcactaatatatactacaccaaaaggaggagccggcgcgtccgtggtggaacaagagagaggacggcctcatgctattaataaaaatcgaagagcggggtggaaaagattgctatacatcaaatcaccttcccctctacgcgatatactggatctggaagtcctggcctccaaaactatataagctgttgctttgatataatattttttgtttgtggttggccgtttttgtgaggccgcgtggatgctgttgctattttccagcaatagatcactcatctttttggatatggtggcgttggagtatataccgcctcttaaagagcgtaagtttcgatgcaaagagggtaagttcggcgtgctctctcactacaccacaacttctactcgacgacgtgtgtgttcgtttgtggattattgtgttaagttacatttatgtggttggtatgatcatgttggaattcgatgtcatctttacgtgttcactataatagtaattgtgtgccttgatttgtgattaaacaatatcatgtataaactacaaccgatataatttgctagtcaatgggtt

SEQ ID NO: 86637 - DNA, 784 bp, Zea mays
  misc_feature: Ceres CLONE 1573117
  misc_feature: Encodes the peptide sequence at SEQ ID NO. 86638
aaagctggagctcaccgcggtggcggccgctctagactagtggatcccccgggctgcaggaattcgtctcacccctagaaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactccaagacggtggtggcggtcatcctcggcggtggcgccgggaccaggctcttcccgcttaccagacgcagggccaagcccgcggtgccaattggcggcgcgtacaggctcatcgacgtgccgatgagcaactgcataaacagcgggatcaacaaggtctacatcctcacgcagttcaactcgcaatcgctcaatcgccacctctccagagtcctacgatttcaaccaatgggcgtggccatcggaagacgggattccgtcggaggtttccaggccgccaaccccggaaggccctgggaacgggagggggcaaaaaaggggggttttccaggggggaaccgggcctggaattgccagttttcgggcacaagtttcgc

SEQ ID NO: 86638 - protein, 193 aa, Zea mays
  misc_feature: Ceres CLONE 1573117
  misc_feature: SWISSPROT Homolog: EC 2.7.7.27 Glucose-1-phosphate adenylyltransferase
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRVLRFQPMGVAIGRRDSVGGFQAANPGRPWEREGAKKGGFPGGNRAWNCQFSGTSF

SEQ ID NO: 86639 - DNA, 733 bp, Zea mays
  misc_feature: Ceres CLONE 1573123
  misc_feature: Translation starting site: 208
  misc_feature (695)..(695): n is a, c, t, g, unknown, or other
  misc_feature (696)..(696): n is a, c, t, g, unknown, or other
aaagctggagctcaccgcggtggcggccgctctagaactagtggatcccccgggctgcaggaattcgtctcacccctagaaaaagcatcgccgccccgcctctagttctctctgtcctcgtcttcctactgtaaaccacctcgtccctatccgcggcaaccgttcaccgcgccgcgaggcctgctgatccgaccgacctccgccgtcatggctcccctgcgccgcgcgtctcgcctccttcgatcagccgtctgccggctgaggtctccagcgccggctcgggccttctccagcgccgcggcgaccgagacgggtgccgtgatcgccgctgctgccgtggcggtggccagctccgggctcgggctgtggctgaaaccgccgtcgcttgccgactccggcgaggcgcccggcgaccagatctcggtcgcctgcgccggcgccacggaggcgcgggaggagaaggggtggttcctgttcgcagactcatttcgtagaagggtcttcttcaactacgagaagaggatacggcttctcagtcctcctgagaagagtccacggtagttcgtgaaggaagattaagggggggagcggagccctggagaattgcactgtgctccatcagagttctttatgcagttcgacacaaataatgatggcctcatctcctttgctgagtacatttttttttgtgacannttgctcagcattcatgaagtcaaaatttcactgtggg

SEQ ID NO: 86640 - DNA, 826 bp, Zea mays
  misc_feature: Ceres CLONE 1573131
  misc_feature: Translation starting site: 210
  misc_feature: SWISSPROT Homolog: EC 2.7.11.1 Non-specific serine/threonine protein kinase
  misc_feature (646)..(646): n is a, c, t, g, unknown, or other
  misc_feature (715)..(715): n is a, c, t, g, unknown, or other
  misc_feature (751)..(751): n is a, c, t, g, unknown, or other
caagctggagctccccgcggtggcggccgctctagaatagtggatcccccgggctgcaggaattcgtctcacccctagaaaaaaattcgcgctgttcgttccctttcagccagtcagtcgccgcctccgctgaactggaagtccaaactagctagctcactgggcaccgatttcccccaatttttcgctgccaggaggccgcggcgaccatgggcaactgctgcgccgcgccgtcgacggagggaagcggcaagacccgccccaagaagcagaaggagaacccctacaacgtcgcgtacaaccgcggcgcggcgccgccggcgccggtgcgcccgggcctggtggtgctgcgggacccgacggggcgggacctcggcgcggagtacgagctgggcggcgagctggggcgcggcgagttcggcgtcacgtacctgtgcacggagcccgccacgggggcgcgctacgcgtgcaagtccatatccaagcgcaagctgcgcacgcccgtggacgtggaggacgtgcgccgggaggtggacatcatgcgccacatgccgccgcaccccaacatcgtcagcctccgcgccgcctacgaggaccgagacgccgtgcacctcgcatggaaaccttctgcgaagggaggggagcntcttcgacaggatcgtcgcccgcgggcactacaccgagcgcgccgccgccgccgtcatgcgcaccatcngttgaggtcgtccagaagtgccacagggcatggcgntcatgcaccggggatcttaaaaccagagaaaacttttatatgcaaagcaaaggacagttccccctctaaaaagca

SEQ ID NO: 86641 - DNA, 1174 bp, Zea mays
  misc_feature: Ceres CLONE 1573134
tttgtttgggtttttttttttttttatatttattattttcttatcctcttacttccattccccccaatattattttttaaaactggaactcacctcggtggcggccgctctagaactagtggatcccccgggctgcaggaattcgtctcacccctagaaaaaagcgccccccgcgcacacacgcacacactgtcttagtgtctttctctgcctttctttccctagcgccgcgccggcgccgccattcgatcagtcttcgtcggccgcttcgccggcgacagcatactccagtcggttggttttggcacttcggaccggcggccatggcttccgacggcatcggccccagaggtattactgtttcatctcttcttgtgttcaaaacagacagacgtcaagccgccgagaggaggtacaaatatagattttggggctatgagcacgccattgcgcttccagcgaatctgacatattgggaattcttgttttttttgggtaccttgcaaggccgaaaatttgaacgcttttcttgtttaatttctaagtgccctgttctgccatcccattaagggacattccttaacctgcctcaaattgactccatgaaacatccgtaccggatttggcctttgaaatggaaattccccattggttttttttccagaaaagtttcaattttggcctaccccgttcgcaaaaatatacgcccttttctattattgtaaattttagacccaaccaaaaatagttttagagagggtgttatttttatgagccaccccttttttttagcacgggggggtgttgttctcaccccaccctaaatggtgggtattcaactatgtgccccccctccctccaatttgtagtgtttggagtgctctccactcgggctccacttctccattttattgtgggtaaaaacaaaccaatactgggagattttttcaagcttgtggaataatacctgtagaggtaagagacagtattctagtattggtgccttttttttctctcacgctcgggtatataactcgtgggagaaaacaccttcttagattagacacgacgggaaatatttctttgtaagaagacccatctgatatttttttttatcatcaaaaaaaaccgtgtgaaagggggtacagattgacgcgtcggtgtcaaagggggg

SEQ ID NO: 86642 - DNA, 787 bp, Zea mays
  misc_feature: Ceres CLONE 1573139
  misc_feature (768)..(768): n is a, c, t, g, unknown, or other
ctggagctcaccgcggtggcggccgctctagaactagtggatcccccgggctgcaggaattcgtctcacccctagaaaaaatgccagaatccatgctttcagagctaaattaaccacgcttcgctcatcgctcctcacacctccaaaataatccagtctcagcccccacactgcccgcaaatccaacctttttgggctcaatcaacctccaaatctacctttttcgtcactccatcctgtcctaaatcccctccctcccccccaaagtcatacctttcccactgcgccccccctgcagaaatccatagattcttcgccacttcgattgtccgctgcatgaatccgactccgcgcgcccaattccctgcaaagccccagtctctggcgatttttttcttggaagatttcttcattctttagtggcgcccaattctgctgggagggggttcttggagagggagatccaccatttcgtttcggcttgagcagccggggagctgagcagcgcggcgcccatgtcggactccgagctgtcccagggcacgctagtgttcggcctccacctctgggagctcgtcggcatcggtgtcggtgccgcattcgtgctcctcctcgtcctcctctccctgctctgcctcctcgcctcccgccgccgccgacgccgccgtgctgcccccgtcctccacctcccccgccgtcgtgcccaatgcccagcccaagcaccccgtcaagccccccatagacatcctagatgtgcccctccgcggnatcgcggcccccgccgccc

SEQ ID NO: 86643 - DNA, 759 bp, Zea mays
  misc_feature: Ceres CLONE 1573142
  misc_feature: Translation starting site: 354
  misc_feature (48)..(48): n is a, c, t, g, unknown, or other
ctggagctcaccgcggtggcggccgctctagaactagtggatcccccngggctgcaggaattcgtctcacccctagaaaaaaaaaaaaaaaaaaaaaaaaaatcttgcaaccgaaggaaccaaaccaggcggccaagccgcggacccccgcatccccggtgcggcgcagcggttcctgcctcgtgcacgtctgtataaaccgacggagcgggcgcccgaggacgaggagggaggaaggcagccagtcagccagaggagcctagagccagtcccgtcccgtccatcagccgccacaccacaaacacccaccactctgctctcgcccgcttgctttctctcccccgctccagcttatggcggaggcggcgccagcagccggcggcggcatcggggacatcctcgccacgagcgatcgggacttcctcgtccgcaactccggtgagcaggtgaagatcagcagcgttgaggcgagccctgtggccatctacttctcccgctcatggtgcccgccatgcaggaggttcacgcccaagctttattgaagtatacgaaaaactggcctcacagggcaagagcttcgaggtcgtctttgcttcggccgatcgcaatgaggaagctttcaatgaatactttgcaaagatgccatgggttgcctgtcccttttttctgaaagtggaaggccgtgaagcccttggatggcccggttcaaaggtctctgggtatcccacaccttggccatcctggatgcaaaaaactggg

SEQ ID NO: 86644 - DNA, 773 bp, Zea mays
  misc_feature: Ceres CLONE 1573145
  misc_feature: Translation starting site: 145
  misc_feature: SWISSPROT Homolog: EC 1.4.1.2 Glutamate dehydrogenase
ctggagctccccgcggtggcggccgctctagaactagtggatcccccgggctgcaggaattcgtctcacccctagaaaaaatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggcctttcaaagtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcaccgtcccggcctacttcaacgactcccagcgccaggccaccaagtacgccggcgtcatctccggcctcaacgtcatgcgcatcatcaacgagcccaccgccgcggccatcgcatacgggctcgacaagagtcgagcagcgacgcgagagacgtctcatcttcactcgcggtctgacttctctag

SEQ ID NO: 86645 - DNA, 870 bp, Zea mays
  misc_feature: Ceres CLONE 1573149
  misc_feature: Encodes the peptide sequence at SEQ ID NO. 86646
  misc_feature (435)..(435): n is a, c, t, g, unknown, or other
  misc_feature (449)..(449): n is a, c, t, g, unknown, or other
  misc_feature (450)..(450): n is a, c, t, g, unknown, or other
  misc_feature (462)..(462): n is a, c, t, g, unknown, or other
  misc_feature (823)..(823): n is a, c, t, g, unknown, or other
  misc_feature (833)..(833): n is a, c, t, g, unknown, or other
  misc_feature (850)..(850): n is a, c, t, g, unknown, or other
ctggagctcaccgcggtggcggccgctctagaactagtggatcccccgggctgcaggaattcgtctcacccctagaaaaaagcgcgccgtctagggtttcacagcggtgccccgatccattcgagcgccccgcaccgccgccatggagtttgacgaatacgagtacttggagaaggcggtggagcccgctcctccacaggccaatggttccggctccggctccggcgagaaggaccggggctcgcgccgccgcgagggcggcgaggaccgcatatcgaagcgctctcgctcgggggaggaccgcgaccgggacaggcaccgcagcggccgggagcaccgtgaccgggacagggatgacgtgaaggaggagaggagccgcgaaagccgcgggaaggacaggtacagggacagggaaggggagagaacggggagaangaaaaggggaaacnngcctcctgcccngagacgagggaaaagggaaatgggagccgaaggagcacggaacctcgttcagagcggtaccccgtggccgaggaaaaacgaaaatggattaaggagacgtgggacccgggaagcccgtacgggcacccgaggcggacattctcctattcaagtccatgggatgggcaataattaaaaccccattgaggcccgtcttcgagaaaggcgctccggccaattgcggacctgtaaccaaagaaattccagggcctaaggcaaaaattgacggggggcagtaagcccgtaaatcttatccccccgaaaagggagacccggggggctcttttttttggccgtccctagcagattcttgttgaaacgnccagcacaanaacaaatatgtgctttnggaagaggcccgactcaaac

SEQ ID NO: 86646 - protein, 164 aa, Zea mays
  misc_feature: Ceres CLONE 1573149
  misc_feature (98)..(98): Xaa is any aa, unknown, or other
  misc_feature (103)..(103): Xaa is any aa, unknown, or other
  misc_feature (107)..(107): Xaa is any aa, unknown, or other
MEFDEYEYLEKAVEPAPPQANGSGSGSGEKDRGSRRREGGEDRISKRSRSGEDRDRDRHRSGREHRDRDRDDVKEERSRESRGKDRYRDREGERTGRXKRGNXPPAXRRGKREMGAEGARNLVQSGTPWPRKNENGLRRRGTREARTGTRGGHSPIQVHGMGNN

SEQ ID NO: 86647 - DNA, 904 bp, Zea mays
  misc_feature: Ceres CLONE 1573152
  misc_feature (897)..(897): n is a, c, t, g, unknown, or other
caagctggagctcaccgcggtggcggccgcttcagactagtggatcccccgggctgctcgcattcgtctcacccctagaaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtgaaagagatccatcaggcggtgagtgggaggggcggcgtccacacaaccggaggggaggggggcaatggcggccgtggcagggccactactgctgtggctcgtctccgcgtgcttatcgtgcggaatgcgacggctgaagagcacaagcagaaagcattttttcgccaggcggaaattcgtcgatggggggcgggggtaatggccttgtgccatgcgacctcactccttcatggtgcgacgggtcttctcgggctttgggacgacgcatctggtgaattgactaacggggccggagttgcccttactagagctataaaaaggagtgggtctagttggaagaattaagaggttacccccgaggatgcttatatcatatgggggaggggggtgggtgtgtttcgaggggtgtgtagggaggggttaggggatactcctttggtggccgtgtcgttcttggaagtttattttagtgaaacaagtcttcgtatatggagtggtcatccgccaacatngttggaa

SEQ ID NO: 86648 - DNA, 793 bp, Zea mays
  misc_feature: Ceres CLONE 1573153
  misc_feature: Encodes the peptide sequence at SEQ ID NO. 86649
aaagctggagctccccgcggtggcggccgctctagaactagtggatcccccgggctgcaggaattcgtctcacccctagaaaaaaaccacgagtttttcctgttcgctttgctttctcggctcagctactgctgctctgctaggaacaccaacagtagtgtgttcttgcgccggcttttcttgccgtgtttcgggtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggctggaagagcttaggaatatctggcagcatgttgttaggaggaaattcagtaactgtgatcgtgctaacaatgatggctatgaggagtgcaataggccatcaaatgcagattttgatcttgctcacagccaaattacagctggggcacctgaccaaagtgggaggcccagcaaaaagagaaagg

SEQ ID NO: 86649 - protein, 186 aa, Zea mays
  misc_feature: Ceres CLONE 1573153
  misc_feature (21)..(134): Pfam Name: Response_reg Pfam Description: Response regulator receiver domain
  misc_feature: SWISSPROT Homolog: EC 3.1.4.17 3',5'-cyclic-nucleotide phosphodiesterase
MRPEERDAAVGRVRDQFPVGMRVLAVDDDPVCLKVLENLLRRCQYHVTTTNQAVVALSMLRQNRDLFDLVISDVHMPDMDGFKLLELVGLEMDLPVIMLSVNGETKTVMKGITHGACDYLLKPVRLEELRNIWQHVVRRKFSNCDRANNDGYEECNRPSNADFDLAHSQITAGAPDQSGRPSKKRK

SEQ ID NO: 86650 - DNA, 791 bp, Zea mays
  misc_feature: Ceres CLONE 1573157
  misc_feature: Translation starting site: 152
ctggagctccccgcggtggcggccgctctagaactagtggatcccccgggctgcaggaattcgtctcacccctagaaaaagtggccagttcgccactcgctggttgctgcacgcctctagtcggcggggccaagaggtggaaaagggcaggatgaagtccggcgagcggcctaagcagatgcggggcgtccagcaggaatctcggcggttccggcttctggtcatcatagccggcttcttcctcgtctccctgaccttcgtcgtcatctccaagcccgattccatcctgtccagcctgaacggcaagctgccggtggaccaggcgccgacgtccatcctgatccatgcagaacgttaactcgccccccaccaccgctcttgagacctccaccgacgcactgcgtggagaccctacagtggtcgatgacgaagccgatccaagaccacaggggttctagggcgaggaggaagagatgccgggcactgagcgagccggacgcgaccagcgggatgactgagctgacccccgacaaggacggctgcggccgtaaatcctacgaggaggtgctaggcggcggatgtgacggcgatacgaatactaaagaggaccgcggccacgggccggagaagcatagagtgacgctcactaccgtttccaactacactattcatgactccgaggacaccccaaatgcctagctagacgatacaagttatgaccagcaggggagcaagccccctgtgcgacttctcaattttcaaagcaaacgtgtgcgacactgcatggtgta

SEQ ID NO: 86651 - DNA, 723 bp, Zea mays
  misc_feature: Ceres CLONE 1573159
  misc_feature (279)..(279): n is a, c, t, g, unknown, or other
aaagctggagctcaccgcggtggcggccgctctagaactagtggatcccccgggctgcaggaattcgtctcacccctagaaaaaatcccatccatcacagctagctggagtacagacgaataatctcttcttcacctcactagctaacaccagctagcagctcgatcgctctgtcctgcaataataggccgctcgcacctcctcccagcagctggtcgcggcggcagtcctggcaacggcgctgctgctgactggcggcgggggccgtggacagcgtcnaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtcttttgatgccaaagcgcctcaattgggcagggaggggttaaagggatggcccccccgccccccccaaagggggggaaaaaaaaggggggccctaaggggattttcgggggcggggaaaaaaaaaataaaattttgttttcccaaggggggggggaaaaaaaatgttttggccaaaaaaaaaaaccccccccgggggggttttcaaaaaaaagggggggggggaggaaggagaaaaaaatttttggggggggggggaaaaaaaaaaaaaaaaaaattgtggtttttcccccccccccccccccctaaaaataaa

SEQ ID NO: 86652 - DNA, 774 bp, Zea mays
  misc_feature: Ceres CLONE 1573163
  misc_feature: Translation starting site: 253
ctggagctccccgcggtggcggccgctctagaactagtggatcccccgggctgcaggaattcgtctcacccctagaaaaagccacaccaaagaccaaacttggctcgtgtcgtgtctcagtgtctgccaccgagacaaaaatcgtcgtcagaaatttaacgacgcatattcgtctgactgacccgcccgtgcgccttcctcccgcctccccttccaccaccaagagtgacgacagagagacagacagagagaatggcggcgccagatgcccggccctcgtcagccggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctcctcaacgacaccttctggcgccggcccggcgccggcgccggcgacgacagccccgggcccgctgttcgtgtacacgggcaacgagggcgacatcgagtggttcgccaccaacacccgggttcatgttcgacatcgcgcccacgttcgggcgccctcctcgtcttcatcggagcaccgggttctacgggg

SEQ ID NO: 86653 - DNA, 777 bp, Zea mays
  misc_feature: Ceres CLONE 1573164
  misc_feature: Encodes the peptide sequence at SEQ ID NO. 86654
  misc_feature (601)..(601): n is a, c, t, g, unknown, or other
ctggagctcaccgcggtggcggccgctctagaactagtggatcccccgggctgcaggaattcgtctcacccctagaaaaatcgtcctctcctttgccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaggacgaccctggcgggagatgacgaggatcttcgtgcagcgcgggaccgccggctcctcgtccagctccggccgctcggacacgcagccagtgcagccggcagcagctgcccgggaaggaggaagttgccgctgcaacctcaaccacagctgccnggagctattgggccatagatgataccaactgataaatttaaattgaggggcagcgaaggaatatccagcaataaagcccttttgagggacgggatgaacaccccttttcaagaaaagactcaaagcttccccccaaaaggaaaaaagaggcctggccccgggggaagaaagaccca

SEQ ID NO: 86654 - protein, 52 aa, Zea mays
  misc_feature: Ceres CLONE 1573164
  misc_feature (46)..(46): Xaa is any aa, unknown, or other
MTRIFVQRGTAGSSSSSGRSDTQPVQPAAAAREGGSCRCNLNHSCXELLGHR

SEQ ID NO: 86655 - DNA, 784 bp, Zea mays
  misc_feature: Ceres CLONE 1573166
  misc_feature: Encodes the peptide sequence at SEQ ID NO. 86656
  misc_feature (690)..(690): n is a, c, t, g, unknown, or other
aaactggagctcaccgcggtggcggccgctctagaactagtggatcccccgggctgcaggaattcgtctcacccctagaaaaacttttcctcccaccgttcctgtcacccacgcagcacgccggagcagcagtagcagtcgagctcggcatcagctcccttgctgctcactttgcagcacctcgccagctccctagtaacgctctgcacctgccgtcgaactctctcaggttcggtcatccctgctcccttccaaatcagcgccctccactcgactccactactgtgtcgtgcgcgcgcttcctcccgcttccgtcgctgggtgcgtgctcatcttccgtcgcgtgccacctgctcgacagaatgagcagtttggtcgtccccatctcgccgtggttcatcctcaccatgttttcagatgtgtttgtgctgagatgccattcgaagtcgatgatctgttcatcgccaccggccgcaagcaccagttttgttgaacgtgagaacgtcttaatcagttgatatgagttcaaaattgatgtgtcgatctgtggtttgacctagtgttctcggcatgtctatgttctggtcgaggccctagatacgtgattgaagatcctttgtggtgatgaaggtgaaatcagcatagcactcgccaagcattctacagaaggtctggactagagaaccatgntgtttcacgtttgttgagttcggttgggattaggggtgaccctgatcattggctctgggctattagggctaattaaataggccttaattttaga

SEQ ID NO: 86656 - protein, 51 aa, Zea mays
  misc_feature: Ceres CLONE 1573166
MSSLVVPISPWFILTMFSDVFVLRCHSKSMICSSPPAASTSFVERENVLIS

SEQ ID NO: 86657 - DNA, 704 bp, Zea mays
  misc_feature: Ceres CLONE 1573167
ctggagctccccgcggtggcggccgctctagaactagtggatcccccgggctgcaggaattcgtctcacccctagaaaaaagccgcacgcttcttgttgccaaagaattccctgcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctcccccttggctacagcattgaggacgttcgacctgccggatgcgtgaagaattccagtctgctgcttactcccactgcgcgaagaagcatcctgatatcccttttgcttcctcattctagtagtttaggatttcttttctgacactttgaattctgaccaatcttctctgggcctgctggttccctgaataatccaaccagtttccccagggcttggtctgatctctccttcgatggtcgtcacgtcatgtgtctcgcggagtccgtcactcggtagctaaagcctgaccttccagacttttgacctggggg

SEQ ID NO: 86658 - DNA, 750 bp, Zea mays
  misc_feature: Ceres CLONE 1573169
  misc_feature: Translation starting site: 164
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaatctctcgaaaccctagtcccctgctccattgtcagccgccgcctatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagaggaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttctaggtcatttctgggcctggtgagaagccaatgattgttgtccatgcacaatggtgaggagaagcagtttgcagctgaagagatctcctctatggttctgatcaagatgcgtgagattgctgaagcttaccttggtagcacgatcaagaatgctgtggtcacagtccctgcctacttcaatgactcgcagaggcatgccactaaggatgcctggggtgattgctggccttaatgtgctgcgtatcatcaacgatgctacagctgcagctatcgcctatggtactgactagaaggctaccagt

SEQ ID NO: 86659 - DNA, 834 bp, Zea mays
  misc_feature: Ceres CLONE 1573172
  misc_feature (834)..(834): n is a, c, t, g, unknown, or other
ccgctctagaactagtggatcccccgggctgcaggaattcgtctcacccctagaaaaaaacacgaggagagactgcggcagcggagtgcagagagcggacgcaacgcaacaccgcccactctctatcactgacgatcgaagcgaggagcgcactgaagccagccgccgtatgtagtcgcctcctcgcgcggcggcacctgtgccggcgtccgtgaatctgcaccctttgcgtgcgtgtccaggtgggtgcacacgccgtcattctcgacggtgtctccggaagaggtttcgggttcgcgcccagcggaagtgcagaattttgtgccaggggcagctggacagcgtctgctaactaggactggataggccatcccctgaacggggataaattcatcaaagtgtgctgaagttcagggagcagaaataaagccattcgctgggagagtttaatcggaatggggcaaaagcatgggacttcacaacccacctttaaggtccggagacggtacctcagggtatgggagatggtttcgggaaaagctgcggcatatggctggggccaacccggcaattcttagaattttctatgcctaaaccttttccagaagggatcttccccaggaacttcccaaaggagactctttggaagaaggtctccagtttccccaaaaaggtggctggggaaaaacttttggggggggaacaaaggctaaccccttttttggggcaagggggattttggcggggacccgggtgtaaccccttcctggggaaaaaaggaaagataaagggggcatcccgggttggggccctttttggggcccaccttcttcn

SEQ ID NO: 86660 - DNA, 792 bp, Zea mays
  misc_feature: Ceres CLONE 1573174
  misc_feature: Translation starting site: 358
aaagctggagctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacagcggcggcggcggcggcggcggcggcagcggccaacggaaaagcgtgctgccacgccgccaaggggcccgggtacgccacgccgctggaggccatggagaagggccccaggggagaagctcgtctacgtcacctgcgtctacaacggcactggaattaacaagccggattaccttgcgacggtgggattttgggatcccagctctccctactactcccaggggattcacaggcttcccgggcacccacatcgggcgacgagctgcatcactcctggctgggaaccccggcagctcctgcccacgggggacccttcggcccaagcggcccccttcctgaaccctgcccttcctttggttgtcagggccgtgggggtatgttcgtcccaaaccagccggacagaaaccct

SEQ ID NO: 86661 - DNA, 1170 bp, Zea mays
  misc_feature: Ceres CLONE 1573175
  misc_feature: Encodes the peptide sequence at SEQ ID NO. 86662
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (686)..(686): n is a, c, t, g, unknown, or other
  misc_feature (738)..(738): n is a, c, t, g, unknown, or other
  misc_feature (739)..(739): n is a, c, t, g, unknown, or other
  misc_feature (744)..(744): n is a, c, t, g, unknown, or other
  misc_feature (963)..(963): n is a, c, t, g, unknown, or other
  misc_feature (988)..(988): n is a, c, t, g, unknown, or other
  misc_feature (1018)..(1018): n is a, c, t, g, unknown, or other
  misc_feature (1118)..(1118): n is a, c, t, g, unknown, or other
  misc_feature (1141)..(1141): n is a, c, t, g, unknown, or other
  misc_feature (1169)..(1169): n is a, c, t, g, unknown, or other
nnnnnnnnttttnnnnnnnnnccaagagccccggggaggggccgccagaaggaaccaccacagcaaggtggaaggggccaaaactggaactcccgcggtggcggccgctctagaactagtggatcccccgggctgcatgaattcgtctcacccctagaaaaaaccatagccgtccgcaccacggcgtcagactcagacccttcacattcccagttccctctgcgccccgtaaaccctagccgcgattcatgggccgcaagcgcctcgcgccttcgggtcctgcgcctccgcgggaggagtcgtcctctgaggaatctggctccgaagagttggaggagcctcctcgcctctccgagctccgtagtcccccggaggccgcggccaacgacgccgactcgtcggaggcggacagggactccgacaccgacgggtcaagctttcgcggatgcgcgaggaggccccccctcccgtcgctggtggaataggggggcccaaccccccccaggccaggaataagagagtccgaaagagagaagaagggacgaaaggcactcaggaatcgcgcgaggccgggagaaaatcccatgtaggacctgtgggcgctcccgcagaagaaaggacgagatgcacagcgggggagaggaaccatgtaggttcggcgccccaggctgggcaggagaagacgnagtggtataataagggtagaaagagagaaaccaccggcgcgtcctcccgcgnnaagancagcacggagagcataaccgcggacaccaccgcgcggacgatgagggcgccacgcgaggaataggacaagagtcaaaagggacgaccatgaagcaatggaccgaaagacacccaatgtgaagaggagcccactacaacgcgactctgaagactgatagaggcggccgatagaggacactgcagaggacttataagaaagaaagaagtgccgcgtgggtncaactaagagggagcacagattaanccataggagcagggaagaaccaaatcacanatcagagattatgaggggctcgaacaaacgcggaatacggcaggcaagagaacaaagcgcagactagtctatgcgagaaggaagctaacctgtcgcacgnaccatagcaaaaagagagctatnaaaagagagacgggagacagcgagacana

SEQ ID NO: 86662 - protein, 78 aa, Zea mays
  misc_feature: Ceres CLONE 1573175
MGRKRLAPSGPAPPREESSSEESGSEELEEPPRLSELRSPPEAAANDADSSEADRDSDTDGSSFRGCARRPPLPSLVE

SEQ ID NO: 86663 - DNA, 850 bp, Zea mays
  misc_feature: Ceres CLONE 1573179
  misc_feature: Encodes the peptide sequence at SEQ ID NO. 86664
  misc_feature (850)..(850): n is a, c, t, g, unknown, or other
aagctggagctccccgcggtggcggccgctctagaactagtggatcccccgggctgcaggaattcgtctcacccctagaaaaaaccggtgccagcagagacgaccggccccggccccgcccccgccgcagctgcccgaagccgccaaacaccaccagtcccccaccacatccgccagaaccctctccctccctccctccctccctccctcactcatcggcgcgccgccaatggccgtgtggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcggcctcgcccttctttccagggtcgccggcgccggccgctcctaagaacggccttggggagcgcccagagagcctggacgtccgcggcgttgcggcgaagccgggagcctcgtctaatgccgtgagggcgggcaagacgcgcgcccacgctgccgtccccaaggtgaacggtggcaagtctgcggtggcggatgtggagcacgagaccataactgtaccttcgtcggtggcgaggactttctacaaccagcttccccgactgggagcatgctccttgctgccatcacaaacatctttcttggccggccgaaaaagcagggggacgatgccttggactgggaagccccaggcgggcctggacatggctcaccggaacactttttgggggtttgggccgggaatccataccaggaatgggggccccaagggttccaagggcaaaaaaccttn

SEQ ID NO: 86664 - protein, 155 aa, Zea mays
  misc_feature: Ceres CLONE 1573179
MAASIAASPFFPGSPAPAAPKNGLGERPESLDVRGVAAKPGASSNAVRAGKTRAHAAVPKVNGGKSAVADVEHETITVPSSVARTFYNQLPRLGACSLLPSQTSFLAGRKSRGTMPWTGKPQAGLDMAHRNTFWGFGPGIHTRNGGPKGSKGKKP

SEQ ID NO: 86665 - DNA, 761 bp, Zea mays
  misc_feature: Ceres CLONE 1573182
  misc_feature: Encodes the peptide sequence at SEQ ID NO. 86666
ctggagctcaccgcggtggcggccgctctagaatagtggatcccccgggctgcaggaattcgtctcacccctagaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaagtgatcagcacaggagtgggtgcgcgattcattgagtttcttacacgtgaggaccatcccccactcccagtttgaggctgcatgggcactcaccaaccattgcatcaggcacatcagagaacactaaagtggtgggttgaaaaagtggtggctgtgccccaatctttggtaaaggttactcaactcccttt

SEQ ID NO: 86666 - protein, 136 aa, Zea mays
  misc_feature: Ceres CLONE 1573182
  misc_feature (4)..(97): Pfam Name: IBB Pfam Description: Importin beta binding domain
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVGARFIEFLTREDHPPLPV

SEQ ID NO: 86667 - DNA, 775 bp, Zea mays
  misc_feature: Ceres CLONE 1573183
  misc_feature (252)..(252): n is a, c, t, g, unknown, or other
  misc_feature (254)..(254): n is a, c, t, g, unknown, or other
  misc_feature (255)..(255): n is a, c, t, g, unknown, or other
  misc_feature (261)..(261): n is a, c, t, g, unknown, or other
  misc_feature (303)..(303): n is a, c, t, g, unknown, or other
  misc_feature (324)..(324): n is a, c, t, g, unknown, or other
  misc_feature (325)..(325): n is a, c, t, g, unknown, or other
  misc_feature (636)..(636): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (691)..(691): n is a, c, t, g, unknown, or other
  misc_feature (692)..(692): n is a, c, t, g, unknown, or other
aaagctggagctcaccgcggtggcggccgctctagaactagtggatcccccgggctgcaggaattcgtctcacccctagaaaaaatatggggaacacccttcaagaactcttttcgtccggaacattaatagcaatgttgaggattctgaattaaaggtcctatttgagcattatggagaaatcagcaacctttacactgcctgcaaacatcgcggttttgtaatgatatcttactatgacataagggtcantnncatggnaaatgccatgagggcacttcaaaacaagccactaagacatangaaaactgtgacatacattannctccattccgaaaggataaatccctttccgggggaaggatatttaacaaggggaatgccttggttggaaattttaaaaggggtgaaacccccctcccggttaaaaaaacaatggattttcccataaaaaaaatttttagggggacccatggggggggaaaaattaaaaaaaaggggggtttcatcccggcggggaaagagacccccccccccccccccaaaaaaaaaagagggcgggcccccctccccccacaaaaggtttgaaaaaaaaatttttttttttacagagaggggggaaaaaaaaaacacccnccccataaaaaggagaggggggggtgggnnnccccccgcgcccccccctttctcnnataccaaaaacaacgggggggggggggggggtctttatttttcttgtggtgggggggggggggggaaagaagaaaaaaaaaaa

SEQ ID NO: 86668 - DNA, 798 bp, Zea mays
  misc_feature: Ceres CLONE 1573186
  misc_feature: Translation starting site: 148
  misc_feature: SWISSPROT Homolog: EC 1.1.1.39 Malate dehydrogenase (decarboxylating)
  misc_feature (575)..(575): n is a, c, t, g, unknown, or other
  misc_feature (685)..(685): n is a, c, t, g, unknown, or other
  misc_feature (750)..(750): n is a, c, t, g, unknown, or other
aaagctggagctccccgcggtggcggccgctctagaactagtggatcccccgggctgcaggaattcgtctcacccctagaaaaagacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgnttggacttgtttgccaaaactacagtggtctgtttcgacgccctaggggaatgtactttagtgcagaagatcgtgggggtagatgatgtccatggtgtacaattggccangctgatcaggttgaccatgatagtggtgactgatggaagcaggatattggggtcttggtggatcntgggggtggcatgggtattgggcattgcctatttgggaaatttgggat

SEQ ID NO: 86669 - DNA, 1238 bp, Zea mays
  misc_feature: Ceres CLONE 1573188
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (1022)..(1022): n is a, c, t, g, unknown, or other
  misc_feature (1155)..(1155): n is a, c, t, g, unknown, or other
  misc_feature (1237)..(1237): n is a, c, t, g, unknown, or other
gttttgtgtggttttttttgcattttgttcttgagggtggttctgggcgggtctcttttccttgntnnncatngttggtggaaaactgggactccccgcggtggcggccgctctagaactagtggatcccccgggctgcaggaattcgtctcacccctagaaaaatcgcagggggcattgagctgcctgcctccgctgccggccgtactacctaatcgccgcacttgttttcccaccgcccgatggccgacatcacgccgccgacgcagacggagccgtcgccgcagacggggcgcccagactcgtctgccaccccctctaccaagcgtgtagggagcagagctggcgccgcccggcaggtcgctgaatgggaaatacgacctgtggcgcctcctggggcacgacaactttcgcgaaggtggatccaagttcagtcaggtctgaaacagaggtacaaccccaccccccaaagaaacatccacaaggaggaaggttgggtgataaaacggggcttcatttccgtcgaaaaccaaggacgaaaaatttcgcttttttcctatctgtccccggtagtcgcctccgcccttaacttctcccttcgccatcctataataacaaaagggtttaaacaggccgttccggaaagtagacccagatgaacaacttagtatatgtgctcaaatagagataaacacatccccacccccaagcccgacccacggaccatagaaaatttcccttatcacaattcccacgccctcattgaagtaatatatattagggggagggccccctctgtaaaacttcctcaatatggggagaaagggtgtacactaccattaatagagtgtccccatgcacggatgttgtggatattatctctcctactaacgcgttacagttctactctcatcatctttcacaagagaaataaagaagaggggagggtatacctcaatgacaacaataaaggagaaccggagttatggaggaaggtttagaatgaagcttaccaccccggngcgttaaactccgagtgaggatgttccactccggcgtgtataaatatccgtatcaatatggggtagctctcgagcgtataataaaaggtggagtcgataactctctacaccgtaagcggtgttatgtcacganatataattgactaaacgagtgcatatggtctctgtaatatctggggtcgtcgacaatgaaacacaataggtataacactctnc

SEQ ID NO: 86670 - DNA, 760 bp, Zea mays
  misc_feature: Ceres CLONE 1573190
aaagctggagctcaccgcggtggcggccgctctagactagtggatcccccgggctgcaggaattcgtctcacccctagaaaaaacacatttcccttttgtccaagcggatggtcctttgcctatgtctcccatttcgtcagaaggctgcatcaggagacaggaggaggagcatgtctctgtaatcgagtggcattcacaagacggcaaaggagaccaacaacgatgtccaggtctcgaggatgatggccgccgttcctctccacctccggccgccagaagtctggtggcctactagtgctctgctgtctgcactgcacaagactacaagtagtaggggcagtggcacaacatcagatagttgccgcgcgccgcttctttctgcccggccgtcggctctgactctgtcaattggcaccaccgaccgtctgatctgatccatgctccagatgctaatttggaaaactatatgatctttgctgtcagtttataattgccttgcttggtttcagtatttttataccatagatttagggtggtctggcagctttggtgggtctgtctttggtggtgagtaatctttcatctcttcttccttgttatttcattgtagatggacaaggcgaccaagcttttgatttatggtgcttcagcacacatgttgttgtccatgatggccatgggttattgagtctagaaaaagaaaaagagatagtagaaagagtcgggtattacttatgggccaatgggagaaaagggatt

SEQ ID NO: 86671 - DNA, 776 bp, Zea mays
  misc_feature: Ceres CLONE 1573196
  misc_feature: Encodes the peptide sequence at SEQ ID NO. 86672
ctccccgcggtggcggccgctctagaactagtggatcccccgggctgcaggaattcgtctcacccctagaaaaaacgccacacctcggcgcgtcccgccaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaagaccgcccgtccccgcctgccgaggaggacgccaagcgctacgggctcaacgggaacgggagcgggctcggatacgacgatgccgccgtccaagcgtacctcggaagcaacggtaacggtagcgccagcggtaacggcggggcggtgaagcagaaccccgaggttgccgggagcagcgcggccatagtcccggccccggtcccgccggcggagggtgagaggagaaggaaggagagagtggagaatcccgtggaagggaggatgcctctctccactccttacgccatacaatgctgacgctagggaatagacgcatgccatgggaatcaatttatttcgggatgcggagggcctaataaatgggtttttagtggttgcaagcctcggtgtttggccgtttttggaagtgaatagaagtggccgtctcaaaatgtatgggggagggagaaaaacaccatttgtgaggattggac

SEQ ID NO: 86672 - protein, 150 aa, Zea mays
  misc_feature: Ceres CLONE 1573196
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSASGNGGAVKQNPEVAGSSAAIVPAPVPPAEGERRRKERVENPVEGRMPLSTPYAIQC

SEQ ID NO: 86673 - DNA, 783 bp, Zea mays
  misc_feature: Ceres CLONE 1573197
  misc_feature: Encodes the peptide sequence at SEQ ID NO. 86674
  misc_feature (421)..(421): n is a, c, t, g, unknown, or other
  misc_feature (437)..(437): n is a, c, t, g, unknown, or other
ctggagctcaccgcggtggcggccgctctagaactagtggatcccccgggctgcaggaattcgtctcacccctagaaaaaaaactagcttgagcaggacgaagggagcgacgttttataaccacgaataaattttaatattagcaatcgaccgtgttcagctgatgatgaataattacatctgtagttggcctgatatgggattgtagccggacgccgccttcatatagcggccgtcaggaaccccagcaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcgggngtctcctcctcctcgncatccgggtagccgcgggcgcgaagagctcgtccgcgacgtccccaaatggaagcagcacaggctgcccgcgaacgctcccgggaagctccccatcatcgggccaccttcacctcatcgggtcccacccgaacgtcttctttcgcggactccacgccaagtacgggcaccaacgggctgatgctggttgcagggtcggcgcccctgccccaccttctgggttttccaacccccaaggcccccaaaggccttgctccccaacccaagaacaccgttgtggggttcccgccccggggaacccccgtggcccaaattaattcgggttaaatttccccgggacgtgggcc

SEQ ID NO: 86674 - protein, 137 aa, Zea mays
  misc_feature: Ceres CLONE 1573197
  misc_feature (28)..(28): Xaa is any aa, unknown, or other
  misc_feature (33)..(33): Xaa is any aa, unknown, or other
MALEAAYDYLHVAVVQCTPTQAAAVLGXLLLLXIRVAAGAKSSSATSPNGSSTGCPRTLPGSSPSSGHLHLIGSHPNVFFRGLHAKYGHQRADAGCRVGAPAPPSGFSNPQGPQRPCSPTQEHRCGVPAPGNPRGPN

SEQ ID NO: 86675 - DNA, 777 bp, Zea mays
  misc_feature: Ceres CLONE 1573201
  misc_feature: Encodes the peptide sequence at SEQ ID NO. 86676
  misc_feature (722)..(722): n is a, c, t, g, unknown, or other
aaagctggagctccccgcggtggcggccgctctagaactagtggatcccccgggctgcaggaattcgtctcacccctagaaaaaccctctccatcccccctatctcgtggcgacgctggacaccgcgccgccgccctacgccgtggcgactactggacgtcgccggcgccctacgccaggtcttcgccattccattctctggagacaagcacccaacagataccgatcaggcattcaagaagtaaattcttcttctattgtgctgaatatatctgattctacatggctatggtgccaagtgattcatcacatcatggagctgtggacaatagccctaatggattcacccagggtcggcgtgaggaagctaggaaacttgggccatcatggtatttcagtagaaaggaaatagaagaacattctccatccaggagggatgacattgatttgaagaaagagtgtagccttcgaaagtcgtattgcagttttctacaagatttgggcatgaagcttaaagtgccccaagtgacgattgctacagctacggtattctgtcaccgttttttccttcgtcaatcccatgcaaagaatgatagacgaataattgccacagtttgtatgttcttggctgggaaagttgaagaaacacctagacctttgaaggatgttatcctggtatcttacgagcttattcataagaaggattctacagctggccagangatcaagcagcagaaaggaatatatgataaacaaaaagaacttattttactcggg

SEQ ID NO: 86676 - protein, 165 aa, Zea mays
  misc_feature: Ceres CLONE 1573201
  misc_feature (34)..(163): Pfam Name: Cyclin_N Pfam Description: Cyclin, N-terminal domain
  misc_feature (147)..(147): Xaa is any aa, unknown, or other
MAMVPSDSSHHGAVDNSPNGFTQGRREEARKLGPSWYFSRKEIEEHSPSRRDDIDLKKECSLRKSYCSFLQDLGMKLKVPQVTIATATVFCHRFFLRQSHAKNDRRIIATVCMFLAGKVEETPRPLKDVILVSYELIHKKDSTAGQXIKQQKGIYDKQKELILLG

SEQ ID NO: 86677 - DNA, 783 bp, Zea mays
  misc_feature: Ceres CLONE 1573205
ggagctccccgcggtggcggccgctctagaactagtggatcccccgggctgcaggaattcgtctcacccctagaaaaaagcgccacccgcacccggactcggcagcgcttgtggtgtggatcactggctcctgtgtcggtcacggcctcgaacgatcgcctgctgctgatagaggaggcgatggagccggcgctgcggctcctgctgtcagactactacggcgcaatagagtagccgctgccgtcggcgcacgccctcctcggccactgcgttccgacacgagggggccgtcgtcgtcggcatcctcaccagcgtattctccataacgttcctgctccttctcttcgcctagcactggaagctcagagctgcggagtcgtcggggccctacaggagcaccagctctagcagtgggttcgggtcctcctgcaacggcgcgggcagagacctgaggaactccggcgtcgaccgcgccgtcgtggagtccctccccgtcttccgcttcagcgcgctgcacgggcagaatgaaggcctcgagtgcgccgtctgcctctgccggttcgagctcacggaggcgctccgcctcctgcccaagtgccgccacggcttccacgtcgagtgcgtggacacgtggctcgacgcgcactccacctgcccgctctgccgctcccgcgtcgtaccggtaggacgtccgtcctcctcccggaaccgcccaaggccttctaccacagggcccttttgtaccccccggaataattattgcggcggacggccgggcagccg

SEQ ID NO: 86678 - DNA, 737 bp, Zea mays
  misc_feature: Ceres CLONE 1573207
  misc_feature: Encodes the peptide sequence at SEQ ID NO. 86679
ctggagctcaccgcggtggcggccgctctagaactagtggatcccccgggctgcaggaattcgtctcacccctagaaaaaactggagccctataggctatagccatcaccacactcgcctccctctctccctcccacactccaccacccgcgccgccgcctcctactccgccccggcccctctgatccggaccgagcgccggccatggcgctcgccttcgacgagttcgggcgccccttcatcatcctgcgggagcaggagaagaagacgcgccttagggggctcgacgcgcagaaggccaacatcgcctcggccaaggccgtcgcgcggatcctccgcacgtcgcttggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggccgagaagcttctggagcgtggtattcaccccattagggtggctgaaggctatgagatggcgtcaaaggtagcttttgaccacctagaacatatctccgaaaagtttgagttcagtgcagacaacattgaacccctggtccagacctgcatgacaactctatcctcaaagattgttaaccgttggca

SEQ ID NO: 86679 - protein, 177 aa, Zea mays
  misc_feature: Ceres CLONE 1573207
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLEHISEKFEFSADNIEPLVQTCMTTLSSKIVNRW

SEQ ID NO: 86680 - DNA, 962 bp, Zea mays
  misc_feature: Ceres CLONE 1573211
  misc_feature: Encodes the peptide sequence at SEQ ID NO. 86681
  misc_feature (13)..(13): n is a, c, t, g, unknown, or other
  misc_feature (67)..(67): n is a, c, t, g, unknown, or other
gttgtggggtgtnttttttagccggagggttgcgctttctcttccttttcttatgttttgtttttgnaatgttgtgggtgcaaactggaactccccgcggtggcggccgctctagaactagtggatcccccgggctgcaggaattcgtctcacccctagaaaaagtcaaacactgggattgcgcgatcagtacgaacgccgtcaacttcctgattccctctcccggagcctatcgagatgctcttcttcctccgtgtagtgtcagctaccgacggcgctgtctagcgggtctccgcctgctccaagaagcatgccccgcctattgcttccagctccatcgcctctcccctgtctgaacgactcggtgcgccgtgcaccactctccaaatatcaattcttcctgcccacgactcgtaagcgggcaagtccacggcttggcgtgcaaatggccgacatgacctacgttgggagcgcctgggaaccgccccacgacggggtttccatgcgagagtgaccccattgtgggaggcggaggcgcccctcccgcccggggtggcgaaccgagcagcgtgggcgccccgtggaggcctgccgcgaaatcgcgacggtctacgcgctctctggggccatgaccgccgtaaggtgtccctccgaccaaaagaattactgacttattgaggataaatcgacgccttggttctttgttttgccacccggataagcataaggccactgctaaaaaaagatcccctagcccttttagaaactttacagagtttttccaaaacctttggtttcgggcagaggaatggagggaaaagggttccgcctctcttaaccccacgaaagagagcctttagccacaaataggccaccttcaatgtttatagcccaaaatgcctcccagggcaatattaccggggaatgtcgcttccggatagggtgtgtttaatatttaagaa

SEQ ID NO: 86681 - protein, 67 aa, Zea mays
  misc_feature: Ceres CLONE 1573211
MPRLLLPAPSPLPCLNDSVRRAPLSKYQFFLPTTRKRASPRLGVQMADMTYVGSAWEPPHDGVSMRE

SEQ ID NO: 86682 - DNA, 825 bp, Zea mays
  misc_feature: Ceres CLONE 1573212
  misc_feature: Encodes the peptide sequence at SEQ ID NO. 86683
  misc_feature (26)..(26): n is a, c, t, g, unknown, or other
  misc_feature (44)..(44): n is a, c, t, g, unknown, or other
  misc_feature (57)..(57): n is a, c, t, g, unknown, or other
  misc_feature (67)..(67): n is a, c, t, g, unknown, or other
  misc_feature (68)..(68): n is a, c, t, g, unknown, or other
  misc_feature (87)..(87): n is a, c, t, g, unknown, or other
  misc_feature (119)..(119): n is a, c, t, g, unknown, or other
ataagctggagctccaccgcggtggngcggccgctctagaactnagtggatcccccngggctgcagnngaattcgtctcacccctangaaaaaaaaaaaaaaaaaaaaagcagagggcnggcggcagcagcagcaaatccctggctcctcctccccggccccaaaaccggacaaacccctgctcctcccgccgccgccgccgccgccggggcacgcccggatgcagaagccagtggcctccgtcgcctccctatgcccgcagctatggcaccgccacttccatcgcgctcccctcctcccccgcgcccgcggcctcccctcctcctctcctatcctcacacgccgccgctccgtactcccccgttccacttccactcacctcgccgcggtgtcaaccgccgccgccgccgtcgaggccccatcagccacaccgtacccagtgtacgatcggcttctgccgtgccccttgcaggacgaccctccgaggattgagcacctcgtggctcgggaggacgaggtggcagccgaattcatctccaggtcgctcgggctgcctcctctgtatgctgcagacctcatcgagttcgggtgctgggtactacgcgctcgtcggccccgaaagccgcctccctaagctttctccgggagcattttaagcctctttcggggaaagccaccgaagcccttccggtcctggggcccggaagggccgtcccatttcaagggggaaaaacccgggggaggggaagggcctccaaaaaaaaaccttttcccgcgggggggaaacgggaaccccccaaacccggggggccctcccgggagggg

SEQ ID NO: 86683 - protein, 137 aa, Zea mays
  misc_feature: Ceres CLONE 1573212
MQKPVASVASLCPQLWHRHFHRAPLLPRARGLPSSSPILTRRRSVLPRSTSTHLAAVSTAAAAVEAPSATPYPVYDRLLPCPLQDDPPRIEHLVAREDEVAAEFISRSLGLPPLYAADLIEFGCWVLRARRPRKPPP

SEQ ID NO: 86684 - DNA, 805 bp, Zea mays
  misc_feature: Ceres CLONE 1573218
  misc_feature (401)..(401): n is a, c, t, g, unknown, or other
  misc_feature (668)..(668): n is a, c, t, g, unknown, or other
  misc_feature (760)..(760): n is a, c, t, g, unknown, or other
ggagctcaccgcggtggcggccgctctgcaactcgtcgatgcctccctctgcacgaattcctttagctcacttctatctatttatatctcttcttgcgagacagtgctttctccttgatttatgaattcctcctgcgctcccactgctagctccctgtcgtgcgcacctctctctaacttgatcccccagcactatctccctatctattggactccgcacaccaacgactagatgcgcgcgcggagccacatatgacgagtcccagtgtggctggctgcatccatcctccctgtggcaccttctctgggtataagtcaaatgactgatctgatacggtcgcgctggggccgacggccaggcgtccgtggagcgggtgttcgcggacaaggcggtgccgtcntgtctggagcagctcacgctgcgggcattcgtcgtcagcgcgctgctggccgtcatgttcagcgtcatagtcatgaagctcaacctcaccacggggatcatcccctccctcaatgtctccgcggggctgctaagcttcttcttcgtccgcatgtggacccgccgccgccgaagaggaagggcatacctccgccagcccctttctccaggcatgagaacaacagtcatccagaccctgacgttgtctctgccctaacgggatcttccnttcaacgggtggcttttggccaacctaccctattttgggaattggagtggacaaaaattttccttaaaacaaggcaaacaagaaagtcttanagcatgccttaatgggcctttttaggggatccctcaaccctttgg

SEQ ID NO: 86685 - DNA, 797 bp, Zea mays
  misc_feature: Ceres CLONE 1573221
  misc_feature: Encodes the peptide sequence at SEQ ID NO. 86686
atagctggagctccccgcggtggcggccgctctagaactagtggatcccccgggctgcaggaattcgtctcacccctagaaaaattccgctcctcgcccacgcctcctcctccagtcctccctttcgtcgtcgcttccctccccttcccgttcgaatcctctgaccaccgcagagcctcccccctgaggaaaccctagcgcagccgccgaccgccgccgacccgtagcatggcgtccccggcccggcccgtcgccgcgtccgtctccggcgccttcggcctctcgcccgaccccaagcgctgctccttcgaccaggcgctccggcacaaggatttccaggagaacaggctgttgatgtcatttgttaatttccatgagcaagagaagatctctaaagaaatcgtaacacacgctatagaaagctgcatgaagaaacaagcagataacctgttgaattcactggacgttatcagcggtaggttgtcacagttggagttatactgctatagactggaaaggtccattggagaattacgaaagtgacgtgatggattatcataacgaagcaaatctgaaccttccggtgcgttgaaaaagcaagtgaaagaagttcagaaaacctgtgccgggctggtcagggaaaagcaggagcttggctgaaactccgaaaagaaatggcccaaaacttcaggataggtacaggaagggattccggccccaaaaaaaggggaagggtcctggcctcccctccaggttttctctggaaatagggggaaaaatggaggggttggccccct

SEQ ID NO: 86686 - protein, 104 aa, Zea mays
  misc_feature: Ceres CLONE 1573221
MASPARPVAASVSGAFGLSPDPKRCSFDQALRHKDFQENRLLMSFVNFHEQEKISKEIVTHAIESCMKKQADNLLNSLDVISGRLSQLELYCYRLERSIGELRK

SEQ ID NO: 86687 - DNA, 1000 bp, Zea mays
  misc_feature: Ceres CLONE 1573223
  misc_feature: Encodes the peptide sequence at SEQ ID NO. 86688
  misc_feature (84)..(84): n is a, c, t, g, unknown, or other
aaaataagagaaggtgttgtggggacgggcggaggaggggaagaaaaggcatagatatagaggagttttaatgggcgattgggnaaaaactggagctcaccgcggtggcggccgctctagtactagtggatcccccgggctgctggaattcgtctcacccctagaaaaagccccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcgagcggcgtcagcgcggcgtcctacgcgtctgcctgtggagtgcgccggaacggtggcggccgtacccacccggcccatcgcagaatccaggggcatccgcccgtggggccaaacgaagggtggtttcagcggtcccggcccaagaaaacgttggaaccgggccgccaagctctgggttcccccggggcccaatgggggcccaatacggggggcaaaccggcccggccgggccttggggccctaaggggcttccggggccccctccgaaaacggggaggacccaggtccctaagaggtgagtccggttccgacccccaattcgggcggccttcacgggggcggccttccggcaggtcggtccccataacccccgtttcccctcccggacgagggccgccccttttccccggggaagaggaacccttccacacccaagaggcccgttcattgtaaagagccccagggcctccgaaaccttccctggggcggccaaaacccgcgggt

SEQ ID NO: 86688 - protein, 239 aa, Zea mays
  misc_feature: Ceres CLONE 1573223
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAASGVSAASYASACGVRRNGGGRTHPAHRRIQGHPPVGPNEGWFQRSRPKKTLEPGRQALGSPGAQWGPNTGGKPARPGLGALRGFRGPLRKRGGPRSLRGESGSDPQFGRPSRGRPSGRSVPITPVSPPGRGPPLFPGEEEPFHTQEARSL

SEQ ID NO: 86689 - DNA, 763 bp, Zea mays
  misc_feature: Ceres CLONE 1573236
  misc_feature: Encodes the peptide sequence at SEQ ID NO. 86690
  misc_feature (559)..(559): n is a, c, t, g, unknown, or other
ctggagctcaccgcggtggcggccgctctagactagtggatcccccgggctgcaggaattcgtctcacccctagaaaaaccgctgagatggccgacgtggattccttctttgcgtgcccggcgcgctgctgattcgttaactaaacaatgaggcagcagactggtaagcgtccctcccaacacagggaatatgaaagagaagaaaggaaggaccaacacaagaggccgtttccccgtgctcaggaaagctctaataatgatgggctggttctttaccgtatactctgtccagacagtttgattggtagtgtcataggaaagcatggcaatgtgataaatgctatcaggcatcagacaagtgccaaagtcaaggttgttgacccgtaccccggtgcagacaaaagggttatcttggtatattgctacgtcaagcatagagaccttgatgctgagggtgatgacaatgagcctgtttgtgcagctcaagatgcattacttagggtgcataatgcaattgttgatgcactgcagacattacataagaatcataaagactctngatagaagagcacagaggaagctaacatttcttgtgcccagctagtcagggcatcaaatggttatagggaaaatctgggtgctgtcatcaaagcatcttccgggtcaacatcaaagagcatttcatttaaaggtgagccccaaaaagatcccaaggtggacccctacaccatttcatggtggcttatggagttttttggattac

SEQ ID NO: 86690 - protein, 137 aa, Zea mays
  misc_feature: Ceres CLONE 1573236
  misc_feature (42)..(116): Pfam Name: KH_1 Pfam Description: KH domain
MRQQTGKRPSQHREYEREERKDQHKRPFPRAQESSNNDGLVLYRILCPDSLIGSVIGKHGNVINAIRHQTSAKVKVVDPYPGADKRVILVYCYVKHRDLDAEGDDNEPVCAAQDALLRVHNAIVDALQTLHKNHKDS

SEQ ID NO: 86691 - DNA, 1119 bp, Zea mays
  misc_feature: Ceres CLONE 1573244
  misc_feature: Encodes the peptide sequence at SEQ ID NO. 86692
  misc_feature (12)..(12): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (62)..(62): n is a, c, t, g, unknown, or other
  misc_feature (65)..(65): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (736)..(736): n is a, c, t, g, unknown, or other
gggggggggggntcntnncagttgttgttggggtagtgggcgggtttctattattcgattgnagngggtnnnnnnnnaaaaagctggagctccccgcggtggcggccgctctagaactagtggatcccccgggctgcaggaattcgtctcacccctagaaaaagtcgaacggaacccagaggaacagagcagacgacgcgaggcgatttctgcgggtttgcttgctccatctgtagaccttaagccgccgccgggcgaccgtgcgcgtgcggtgctcacaccccaccccgctcaggtgaaggcacttcaagatgggcgaggtacacgaagctgacaagaacattgagatctggagggtgaagaagttaatcaaggcacttgatgctgcaaggggcaatggaactagcatgatttctctcatcatgccacctcgtgatcagatttcacgccccactaacatgctgggggatgagtagggaactgcctcaaacatcaagagcagaggtcaacagacaggtctgtggttggctggccaataaccttcggtctcaacaagagggttgaaagccttttgcaggcccgaagttcccccccccaactgggtttttgggcggcctctaaatacctggggtaaccaattggatccaacccgtagtggaatgggcccaaagggcagaacagagacagggttttaaccccctttttgggaacctgttcccgaagggcgctatgttgnctagtgcgggcccccacagatgtataaggtgggccttttaccccgcctggggtattttcagctcatgtggtggagaccacaaacacaaaggggtctctcccctacaaacctgtgggagaggccccccttgtggagaagtggaagggcgttttccagtgaaaactggcgggtgggattgggaacacaaggcgtttgtgggggttgttccaaataacaagtccagtgtggagaaagtgggcacaataggggggacaacaactggggggagttgggggtaacccctctggtgagcgcgccaaaaaaagacattcaaggaggaaaaaggtctctcttgtttacaaaagggtgttcggaggcgtggtggagaatccttatcctaaaga

SEQ ID NO: 86692 - protein, 54 aa, Zea mays
  misc_feature: Ceres CLONE 1573244
MGEVHEADKNIEIWRVKKLIKALDAARGNGTSMISLIMPPRDQISRPTNMLGDE

SEQ ID NO: 86693 - DNA, 783 bp, Zea mays
  misc_feature: Ceres CLONE 1573246
  misc_feature: Encodes the peptide sequence at SEQ ID NO. 86694
  misc_feature (592)..(592): n is a, c, t, g, unknown, or other
ggagctcaccgcggtggcggccgctctagaactagtggatcccccgggctgcaggaattcgtctcacccctagaaaaagtctagcattttcctacacccaatctgatctgaccaagccctctgaacacccccgcccatcctcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccagcagcggccccaactcccgcagcgccgcgacgaagaagtcgaggctcggcgtcgcgaggccgagaatgagcgcgcccgccgcgacctgcactggnagcagaaacgccgcacgcaccatcagttcaaccgcggcggtcccctcctcgtcgtctggcaaacccgtccgttgacatcccagccccgagttggtccggtgaaaggaagcagatcccttttctcatccttttctcaaagctcttctttcggcgggtcgccgaaccagccccgaaggaatctccctcggtcc

SEQ ID NO: 86694 - protein, 204 aa, Zea mays
  misc_feature: Ceres CLONE 1573246
  misc_feature (141)..(141): Xaa is any aa, unknown, or other
MGFDVGLVPYNPDGWGPPEVAAAPPSLGGGSSSVPFAPFSRSDKLGRIADWTRNPPGPGAFAAARDAVFDFAGLEDSIGLASADDSSFRLVDGKPPPRHPRFGPRWRFQQRPQLPQRRDEEVEARRREAENERARRDLHWXQKRRTHHQFNRGGPLLVVWQTRPLTSQPRVGPVKGSRSLFSSFSQSSSFGGSPNQPRRNLPRS

SEQ ID NO: 86695 - DNA, 777 bp, Zea mays
  misc_feature: Ceres CLONE 1573249
  misc_feature (744)..(744): n is a, c, t, g, unknown, or other
caaagctggagctccccgcggtggcggccgctctagaactagtggatcccccgggctgcaggaattcgtctcacccctagaaaaagccccttgccccctccctctccgtctccgattctggatctgcccatgccgtaacccgcaggctcccggcatctcgttctcgcctccaaaattcaccttcgccgattgccgccgtgggccgccgcgatggcgttgcggacgcctcgtaccacctccgtcgcattctccgctgactcccccctcggtggcgtcccactgcgctcctcaacagcctgctccattcccacgccacctcctctcgctccgctgcgaccaccgaggaccaccagagcgggacgccgcggaactcgtcggccacgtcctggccgtcgcgcatgctgacgacgaggccgttgccctcccgggcaccctcgacgcggagctcacgcgcgtcctgcgagcgcacggcgccgctcaggtacgccttcacctcctcgtaggtgctgtcgttgtcggagacggggccatagcgtgagtagcgcacctcgccgccgggctccgagatgtcgatggtcacgtaggggtccacgacgttgagtaggcggcgggcgcgccggcggaggaacaggttgaggtaggtccagaacagaggacagggagggacctaaaaatcaagcccaaaggcccaaagcccgaagtttcttttcttccccgcaaagaaagaagggcagagttctcggncttctcgcaagtcgcgacagagaaagaggcgga

SEQ ID NO: 86696 - DNA, 791 bp, Zea mays
  misc_feature: Ceres CLONE 1573251
  misc_feature: Encodes the peptide sequence at SEQ ID NO. 86697
  misc_feature (788)..(788): n is a, c, t, g, unknown, or other
ctggagctccccgcggtggcggccgctctagaactagtggatcccccgggctgcaggaattcgtctcacccctagaaaaagctctaccaccgtccaccatcaccgcctcgtgtgcagagtgctcgctcacctcctctgtcgacgcaccaccccgaagcccccccgccgcgctcgcagggtgttcaacccttcgcccgcgcgccctcacgacatggcctcctccgtctccgccgccgccaaggccgccgcggcgttcgcgcacaaggtccagcagaaggagctggccgcgccggcgcagcgccgcgcgggcttgacccgccggaccaagccgtgcagcgtgcgcgccgtcgcttcacccgcgcgcgccctgtcgtccaccggctcggtgaagagcgcgatgactatgactgagaagatactggcgcgggcgtcggagcgcgcggcgttggagcccggggagaacgtgtgggtcgacgtcgacgtgctcatgacgcacgacgtctgcgggcccggcgccttcgacatcttcaagaaggagttcggggaggacgccagggtctgggaccgcgagaagctcgtcgtcatcccggaccactacatcttcaccagcgacgaccgcagcaaccgctacgtcgacatcctcatggacttctgtgcagagcagaacatcaagtacttctatgacatcaaggacctcagcgatttcagggctaatccggactacaaaggcgtctgccacatcgcacttgctcatggatgccactgccgaccagccgatgttctctttntga

SEQ ID NO: 86697 - protein, 192 aa, Zea mays
  misc_feature: Ceres CLONE 1573251
  misc_feature: SWISSPROT Homolog: EC 4.2.1.33 3-isopropylmalate dehydratase
MASSVSAAAKAAAAFAHKVQQKELAAPAQRRAGLTRRTKPCSVRAVASPARALSSTGSVKSAMTMTEKILARASERAALEPGENVWVDVDVLMTHDVCGPGAFDIFKKEFGEDARVWDREKLVVIPDHYIFTSDDRSNRYVDILMDFCAEQNIKYFYDIKDLSDFRANPDYKGVCHIALAHGCHCRPADVLF

SEQ ID NO: 86698 - DNA, 917 bp, Zea mays
  misc_feature: Ceres CLONE 1573256
  misc_feature: Encodes the peptide sequence at SEQ ID NO. 86699
  misc_feature (709)..(709): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (917)..(917): n is a, c, t, g, unknown, or other
aagctggagctccccgcggtggcggccgctctagaactagtggatcccccgggctgcaggaattcgtctcacccctagaaaaaactcgtgtccgatggctcgcccccgccgcctcctctgacgacggtctgactgacccccgcctccccggagagcggctccgctgtctcgccggatatggcgccgcctcgtccccctcctaacccggcgggggagcagcagccgcagctcccggggtggtcatcatcacgctccctcccgcggaccagccctccaagggcaagaccgtcaccgccttcggctacaccaacgaccccccgccccctcgctcgcccccggatccggttatggggtacccgggcggccaaccgaggctaggccggcggcccaaggggggcgctcctcgacaccggcgggttggcgaccggcgggcgcctcgtggctggggcgcgcctcccgggtccccgccctaactatttggctttctaacccgggaccgtggcccgtgccaagttttcctggggggattgggaccccgggagggaggtgaccacaagggaaccgggaaccccggggtctcttttcccgggggggggcccggcttttttatccccccaaggggggggggggtgttcaagggggggcgcgcggcgacacattttgggcggcgagaagttttttcgggggggagaacattttttaaaaaggngttccccccccccccacaaaagggggggggggcaaannnnttggaaaaaatcccacgggggggattaaataaagggtggctggcgagacacacgcgtggggggtgggggcggtccccgtcaaaaggaggggcccccacccgccggggtaaggggacaactaatctttcttgcccggcgcgggtgggtgtctctcccccaacctataan

SEQ ID NO: 86699 - protein, 41 aa, Zea mays
  misc_feature: Ceres CLONE 1573256
MGYPGGQPRLGRRPKGGAPRHRRVGDRRAPRGWGAPPGSPP

SEQ ID NO: 86700 - DNA, 790 bp, Zea mays
  misc_feature: Ceres CLONE 1573259
  misc_feature: Encodes the peptide sequence at SEQ ID NO. 86701
  misc_feature (634)..(634): n is a, c, t, g, unknown, or other
  misc_feature (759)..(759): n is a, c, t, g, unknown, or other
aaagctggagctccccgcggtggcggccgctctagaactagtggatcccccgggctgcaggaattcgtctcacccctagaaaaaagcagtaagaagagttggttgggattcagcaaaaacccgagatcgcaccccttcgcgtggcgatgcgtggaggagacgtaacagcagcggaggcagggtccccgcgctcgccggacctctacgatctctccgacgactccgactacgccgccgccgcttctgaccaaacggcgatgcggaccgatcccgcggacagagcctcagaggagactgcgagggtggatgtggtatatgagaaggagcgtgtgaccatccacccgtcgcagtatggttccagtcgtatcagcgggaagctgcgtctgtttctgcagcagggatcattgttcctgagttgggagccaaacgaaggagccggctctttgtcaaccagttcagtcggtgtggaagtagaaaaatatagaaatctgtacactatcaaggccttgcctttaagtgatgtacgcttcatccgtaagtacaccccaacgtttggactggactacgtaataattgttctctcatcaggcctggctttccctccattctatttctacaacgggtggaattcgtngaattgtttgcaacactggaaacaacatgtattcatcatcagggtcggatgacgatccctaatgttttttctcgtcaacgaactttcaagatcccccttcagataagcttgtcatcccttggagncttccaggtagtagccctcagttagcaaatg

SEQ ID NO: 86701 - protein, 179 aa, Zea mays
  misc_feature: Ceres CLONE 1573259
  misc_feature (163)..(163): Xaa is any aa, unknown, or other
MRGGDVTAAEAGSPRSPDLYDLSDDSDYAAAASDQTAMRTDPADRASEETARVDVVYEKERVTIHPSQYGSSRISGKLRLFLQQGSLFLSWEPNEGAGSLSTSSVGVEVEKYRNLYTIKALPLSDVRFIRKYTPTFGLDYVIIVLSSGLAFPPFYFYNGWNSXNCLQHWKQHVFIIRVG

SEQ ID NO: 86702 - DNA, 789 bp, Zea mays
  misc_feature: Ceres CLONE 1573262
  misc_feature: Encodes the peptide sequence at SEQ ID NO. 86703
ctggagctccccgcggtggcggccgctctagaactagtggatcccccgggctgcaggaattcgtctcacccctagaaaaatatactgaacaaacttacaccagagaaattcgatcttttaaagggtcaactaatggaagctggaattactactgctgatatattgaaggatgttatatctctcatatttgagaaggcagtttttgagcccactttctgtccaatgtatgctcaactttgttctgatctcaatgaaaagcttccgacattcccttctgaagagccaggtggcaaagagatcacattcaagcgtgtgatattgaacaattgtcaggaagcctttgaaggtgctagcaacttaagagctgagatttctaaattaactggccctgaccaagggatggaaagaagagacaaagaacggttggtcaaacttagaacacttggaaatattcggctaattggtgagctactcaagcaaaaaatggttcctgagaagatagttcatcacattgttatggagctattggggtctgggactgataaaaaaaccatgccctgaagaagaaagatgtgaggctatctgtcatttcttcaatacgattggtaaacagcttgacgagaacacaaagtctcggcggatcaatgacacatacttcatccagatgaaggagcctacaatgaatcccccagcttgcaccacgatttgaggttatggggtcgtgaatgtgattgatcttccgtcaaataaactgggtgcctcgacctggagagaattaaggccaaaaca

SEQ ID NO: 86703 - protein, 142 aa, Zea mays
  misc_feature: Ceres CLONE 1573262
MEAGITTADILKDVISLIFEKAVFEPTFCPMYAQLCSDLNEKLPTFPSEEPGGKEITFKRVILNNCQEAFEGASNLRAEISKLTGPDQGMERRDKERLVKLRTLGNIRLIGELLKQKMVPEKIVHHIVMELLGSGTDKKTMP

SEQ ID NO: 86704 - DNA, 770 bp, Zea mays
  misc_feature: Ceres CLONE 1573265
  misc_feature: Encodes the peptide sequence at SEQ ID NO. 86705
  misc_feature (509)..(509): n is a, c, t, g, unknown, or other
atagctggagctccccgcggtggcggccgctctagaactagtggatcccccgggctgcaggaattcgtctcacccctagaaaaagaagtggaagctggatccttcctcgagaactcgttcgctcgctacgtttccctccgcttgccgagtgctgcgcgggagctcgcgcccttggcgactccgccgccggcggctacggcgtccgcgcttcccaagtctggggcggtatccaagggctacaactttgcatccacttgggaacagagcgcgccgctcacggagcagcagaaggccgcgatcgccgcgctctcccacgccgtggcggagcggccattcccgcccatcctggataaaacttcagggaaggatgaaggcttggctgttcccgagaaagaatctgctttggacgaggccggtgcaatatatgctgtcttggtgaatacacatcagtcctacaagtggttttcagagctggagtcagctatgaaatctgagactgacgaaaaatntcgactttatgagaatacgttacaggagcgtgtcaacacatcgtgacgtcatccttaagcaggttgatgatactttgagcttatgcggaaaaactgcagtcttttgctctcaagcgcttccaccgaaaacaaaaacttttgcatggatgcttgcaaccccaccttttgggttgtggaaacaaagggctgatctttgttttgccaaatgccccgttccgaaagcaagggctcaaatttaccttttgaatggaatttaaggat

SEQ ID NO: 86705 - protein, 184 aa, Zea mays
  misc_feature: Ceres CLONE 1573265
  misc_feature (170)..(170): Xaa is any aa, unknown, or other
IAGAPRGGGRSRTSGSPGLQEFVSPLEKEVEAGSFLENSFARYVSLRLPSAARELAPLATPPPAATASALPKSGAVSKGYNFASTWEQSAPLTEQQKAAIAALSHAVAERPFPPILDKTSGKDEGLAVPEKESALDEAGAIYAVLVNTHQSYKWFSELESAMKSETDEKXRLYENTLQERVNTS

SEQ ID NO: 86706 - DNA, 1973 bp, Zea mays
  misc_feature: Ceres CLONE 1573266
  misc_feature: Encodes the peptide sequence at SEQ ID NO. 86707
aagtcgctccactctttcgcattttcgctctccatctatgctaccccccctcgccctcgtgccgtgaccagcgaagcttgcggtcttgcggggtacggagatggcgacggcccgggggatgaccccggctgcggcggacgctgtggaggagctcacgcggctgtaccgggagctgcctccgcgcccggccgtggaggaggtggaggcggcggcggcggtgctggcctcggcggacgcggaggaggaggcgcgcctcgccgagatcgccagggaggaggaggcggcgcgggtgcaggcacaggacgtgccggccgagctcttcgacgtgctgtgggaggccaggcgcaactccgtgcgcctccgctcgctgctgcagcggaaggaggccgcgcacgtcgtcgagctcgagaggcggttcaagctcttcgacgacctcatccagagggcgtcgcgggtggtttctccaggtgatggtgctaggggcggcggcgacgccgtcgtcgacctcgaggtcgaggcgaaccggaatcccgcgttggctgctgcggtggccgccgcggcaacagagatagaccgtggaagcaagggtggcttgggattggaaccgaagtccgtctcgtcgttgcatcgtgctacatcggcaggtactgacacagaaaagctgggccttatccaagtcgcaagccttatagagtcatcggcaaagaaagggactacagagctcaatctccggggtaagctggtggaccaagttgagtggctccctgtctcgcttgggaagttacaggatgtcacagagcttgatctatctgagaataggatcatggcactcccatctacaattggtagccttagatacttgacaaagcttgacctccactcaaaccagctgatcaatctgcctgatacctttggggaactttccagcctgattgatcttgacttgcgtgcaaaccagctaaagtctcttcctacatcatttggaaatctcattagccttgccaatcttgacctgagctcaaatctgttgaaggtccttcctgattgtttaggaaagttaaaaaacttgagaaggttaattgctgagacgaatgagattgaggagctaccctatactattggatcatgcacctcccttgtggagcttagattagattttaatcagctcaaagcccttccagaagccattgggaagttggaaaacctggaaatcctgacgttacactacaacagaattaaaggtctgcctacaacaattggtcatcttaccaggttgagggagctggatgtcagtttcaatgaagttgagactatacctgagaacatttgctttgcagccagccttgtgaagttgaatgtcagcaggaactttgccgacttaagagcccttccaaaatcaataggggaacttgagatgctagaggagctcgacatcagtagtaaccagataagagtacttccagactcttttggtcatctctcaaagctacgtgtgtttcatgctgatgaaactccactggaagtaccgcctaaagaagttgtaaaattaggggctcaggagctggttaattatatgaagaatatggctgctgcaagggaagtgagccggaaggaaacagatgagaggagcttttggacctggctccgctcactgtttggttgcgaacagaatcaaggatcgggaccagttccagtttagctgaaccatttcatctgcatgtgttgtcatgaaattgttcagtcttggtccatctctcaagtcagcgatgaaacgaggtatggttatcattattatttcccacttttttgtttgtgtatacaatgtatatatgtagcgctttcttgtaaaggttggtttatttctgtgtaattcatctgtatgaaacactgtcatgttactcaacgaaacacgagcggcccaacatttctattaaatacaggatgcattctagcacgaaaaaaaaaaaaaaaaa

SEQ ID NO: 86707 - protein, 532 aa, Zea mays
  misc_feature: Ceres CLONE 1573266
  misc_feature: SWISSPROT Homolog: EC 2.7.11.1 Non-specific serine/threonine protein kinase
MATARGMTPAAADAVEELTRLYRELPPRPAVEEVEAAAAVLASADAEEEARLAEIAREEEAARVQAQDVPAELFDVLWEARRNSVRLRSLLQRKEAAHVVELERRFKLFDDLIQRASRVVSPGDGARGGGDAVVDLEVEANRNPALAAAVAAAATEIDRGSKGGLGLEPKSVSSLHRATSAGTDTEKLGLIQVASLIESSAKKGTTELNLRGKLVDQVEWLPVSLGKLQDVTELDLSENRIMALPSTIGSLRYLTKLDLHSNQLINLPDTFGELSSLIDLDLRANQLKSLPTSFGNLISLANLDLSSNLLKVLPDCLGKLKNLRRLIAETNEIEELPYTIGSCTSLVELRLDFNQLKALPEAIGKLENLEILTLHYNRIKGLPTTIGHLTRLRELDVSFNEVETIPENICFAASLVKLNVSRNFADLRALPKSIGELEMLEELDISSNQIRVLPDSFGHLSKLRVFHADETPLEVPPKEVVKLGAQELVNYMKNMAAAREVSRKETDERSFWTWLRSLFGCEQNQGSGPVPV

SEQ ID NO: 86708 - DNA, 994 bp, Zea mays
  misc_feature: Ceres CLONE 1573267
  misc_feature: Encodes the peptide sequence at SEQ ID NO. 86709
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (572)..(572): n is a, c, t, g, unknown, or other
  misc_feature (706)..(706): n is a, c, t, g, unknown, or other
  misc_feature (829)..(829): n is a, c, t, g, unknown, or other
  misc_feature (832)..(832): n is a, c, t, g, unknown, or other
  misc_feature (833)..(833): n is a, c, t, g, unknown, or other
  misc_feature (862)..(862): n is a, c, t, g, unknown, or other
  misc_feature (911)..(911): n is a, c, t, g, unknown, or other
  misc_feature (926)..(926): n is a, c, t, g, unknown, or other
  misc_feature (939)..(939): n is a, c, t, g, unknown, or other
  misc_feature (943)..(943): n is a, c, t, g, unknown, or other
  misc_feature (950)..(950): n is a, c, t, g, unknown, or other
  misc_feature (966)..(966): n is a, c, t, g, unknown, or other
  misc_feature (990)..(990): n is a, c, t, g, unknown, or other
  misc_feature (994)..(994): n is a, c, t, g, unknown, or other
nnnnnnnnnnccccnnccatcacatgtaaaaaaagtgtctgttgtctgttgttgtgtgggggggggggnnnnannnnnaaaaactgggactcaccgcggtggcggccgctctagactagtggatcccccaggctgcaggaattcgtctcacccctagaaaaaatcgctccactctttcgcattttcgctctccatctatgctaccccccctcgccctcgtgccgtgaccagcgaagcttgcggtcttgcggggtacggagatggcgacggcccgggggatgaccccggctgcggcggacgctgtggaggagctcacgcggctgtaccgggagctgcctccgcgcccggccgtggaggaggtggaggcggcggcggcggtgctggcctcggcggactccgaggaggaggcgcgcctcgccgagatcgccaaggaggaagaggccgcgcgggtgcaggcacaggacgtggcggccgagctcttcgacatgctgtggggaggccaggggcaaactccagtgcgccctccggctcgcttgctgcagccgcaaaggaggaccgcccacggtacgtcnaagcttcaaaaagggccgttttcagaggctccttccaacggaccctccatcccaaaaaggcgcgttctccggggggtgggattctcctcccaaaggtggaatggggtggctttaggagggccccggccgggcanaaacgaccacatcctccccggaaacccttcgaaaggtgtcggaaggcgcgaaaaccccggagaaattccccccaccggtttggggcctcgccctgccgagggcgaggcccctacgctccgcgnccnnacccggccatgattcgctaccccctgggncaaaccccaagagggtgtggggcgtttggggggaattttggagaaaccncgcgaaaggttcccnatcctatcgcgcncagnttgacanaattcgggtgggcttnccaattccggcgccgagggtgtancttn

SEQ ID NO: 86709 - protein, 194 aa, Zea mays
  misc_feature: Ceres CLONE 1573267
  misc_feature (149)..(149): Xaa is any aa, unknown, or other
  misc_feature (190)..(190): Xaa is any aa, unknown, or other
  misc_feature (191)..(191): Xaa is any aa, unknown, or other
MATARGMTPAAADAVEELTRLYRELPPRPAVEEVEAAAAVLASADSEEEARLAEIAKEEEAARVQAQDVAAELFDMLWGGQGQTPVRPPARLLQPQRRTAHGTSKLQKGPFSEAPSNGPSIPKRRVLRGVGFSSQRWNGVALGGPRPGXNDHILPGNPSKGVGRRENPGEIPPTGLGPRPAEGEAPTLRXXTRP

SEQ ID NO: 86710 - DNA, 749 bp, Zea mays
  misc_feature: Ceres CLONE 1573269
  misc_feature: Encodes the peptide sequence at SEQ ID NO. 86711
ctggagctccccgcggtggcggccgctctagaactagtggatcccccgggctgcaggaattcgtctcacccctagaaaaaaaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacctagaacatatatccgaaaagtttgagttcagtgcagacaacattgaacccctggtccagacctgcatggacactctatcctcaaagattgtttacccgttgcaagcggggcggttggcagaagattgctgtcaaagcagttacttgcggggttgcagattttgaaaagggaaagag

SEQ ID NO: 86711 - protein, 197 aa, Zea mays
  misc_feature: Ceres CLONE 1573269
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLEHISEKFEFSADNIEPLVQTCMDTLSSKIVYPLQAGRLAEDCCQSSYLRGCRF

SEQ ID NO: 86712 - DNA, 1090 bp, Zea mays
  misc_feature: Ceres CLONE 1573270
  misc_feature: Encodes the peptide sequence at SEQ ID NO. 86713
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (64)..(64): n is a, c, t, g, unknown, or other
  misc_feature (351)..(351): n is a, c, t, g, unknown, or other
  misc_feature (735)..(735): n is a, c, t, g, unknown, or other
  misc_feature (753)..(753): n is a, c, t, g, unknown, or other
  misc_feature (754)..(754): n is a, c, t, g, unknown, or other
  misc_feature (759)..(759): n is a, c, t, g, unknown, or other
  misc_feature (801)..(801): n is a, c, t, g, unknown, or other
  misc_feature (1081)..(1081): n is a, c, t, g, unknown, or other
nnnnnnnnnnnnnnncccccttccatctttatagtacaaagaataaaaaggatattgtgcatgntttcttctttttttagaaagagtggactccccgcggtggcggccgctctagaatagtggatcccccgggctgcaggaattcgtctcacccctagaaaaaagggcgagtagtagttggcgagttggagcaggtctgggtctggccgtgtgagttatttcccagccaggcatctgagagctttggtcttgacctcgacagagatcgccatggacgcatcggcggaggtggaccacctcgccgccgagaggtcggccgcgcgcttcgacgtcgaggcgatgaaggttgcntgggctggctcgcgacacgccgtcgaagtcggcgaccgcgtggcccgactcgtcgcgtccgaccctgtcttccgcagggataacaggaccatgctctccaggaaggacttgtttaaggacactctatggaaagggcaccccccgccctggaaagcgttattggtcgaaacttaacgtcctccacacgaggtacgaaaacacggtaatgacttgaagggccttattatgtaccggagtcaagacccttggggcttaatatgtttcgaaatcttgagccattttgggggtggagaatggatttttggtgtttccccattgacattatacaataaatgggctcttcaacaggtctgaacactctcctcagaggggagagccaagacncacaggcaataaacatannaactntcggggacctcttaacccaactaaacataggacacctcttancacaatatgtatttatccacataagatgtacaaatttttggaagagaaagcacttaatgtaacaatctcagaatacactgaaaaaactctccagagtgtcaataaggaccctccaaatacgaattaacaaaggggaacccagtgataaagacaaaacgggccccaaaaatatcatagatccctaacgagaaccggaacggaaattttatgtcatgcccccgaatgacacccaatatcattaaacccccccaaaaagaatagggtggccccttgatagccntctagacaa

SEQ ID NO: 86713 - protein, 84 aa, Zea mays
  misc_feature: Ceres CLONE 1573270
  misc_feature: SWISSPROT Homolog: EC 1.3.3.6 Acyl-CoA oxidase
MDASAEVDHLAAERSAARFDVEAMKVAWAGSRHAVEVGDRVARLVASDPVFRRDNRTMLSRKDLFKDTLWKGHPPPWKALLVET

SEQ ID NO: 86714 - DNA, 857 bp, Zea mays
  misc_feature: Ceres CLONE 1573271
  misc_feature: Encodes the peptide sequence at SEQ ID NO. 86715
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (61)..(61): n is a, c, t, g, unknown, or other
  misc_feature (62)..(62): n is a, c, t, g, unknown, or other
  misc_feature (65)..(65): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (98)..(98): n is a, c, t, g, unknown, or other
ccgaaaggncnnnnnccnnnnnnnggggggnnnagcnnnncgggnnntgnnnnnnnnnggnnggntggggggggggnnncccaaactggagctcacgncggaggcggccgcttcataacagaggatcccccgggctgctccacaacggcgcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaaccccgaggttggaatcgcggtggccggaacccataaccgtgcaagaaaccccaaaggcggcccggggggtcccggcggcccgggcgccaagggcaacggtccccaccgaccgaagaagaaccgggggaaccgtgggaacacagcggggccaaacgccccaatcggaa

SEQ ID NO: 86715 - protein, 207 aa, Zea mays
  misc_feature: Ceres CLONE 1573271
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPEVGIAVAGTHNRARNPKGGPGGPGGPGAKGNGPHRPKKNRGNRGNTAGPNAPIG

SEQ ID NO: 86716 - DNA, 902 bp, Zea mays
  misc_feature: Ceres CLONE 1573280
  misc_feature: Encodes the peptide sequence at SEQ ID NO. 86717
  misc_feature (257)..(257): n is a, c, t, g, unknown, or other
  misc_feature (258)..(258): n is a, c, t, g, unknown, or other
  misc_feature (268)..(268): n is a, c, t, g, unknown, or other
  misc_feature (270)..(270): n is a, c, t, g, unknown, or other
  misc_feature (333)..(333): n is a, c, t, g, unknown, or other
  misc_feature (658)..(658): n is a, c, t, g, unknown, or other
  misc_feature (659)..(659): n is a, c, t, g, unknown, or other
  misc_feature (754)..(754): n is a, c, t, g, unknown, or other
  misc_feature (755)..(755): n is a, c, t, g, unknown, or other
  misc_feature (862)..(862): n is a, c, t, g, unknown, or other
caagctggagctcaccgcggtggcggccgctctagaactagtggatcccccgggctgcaggaattcgtctcacccctagaaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacnnttcacttggncncgcctggtgcggtccatgccgcgccatcgccccactgttcgtcgaacacgccaagaagttcanctcaggggtcgtcttccctgaaaaggtggggaccgtggggaaccaaaaggtgaaaggaaaggtccccccgggggcccttcccaaaggggcccaaaggggaaattcccaaacttttcccatttttggttaaaaaaaaagggccaaaaaaaggggtgcccccaacactctttttggggggggggccccccccaaaaaaaaagaaaaaaaaaaccccctgggcgcccctttttataaaaaaaaaaaatccccccccccccccccccccccgccaaaaaaaaaaaggaggggctccccccggaaaaaaaaaaaaaaagaaaaaaaaaanngggaaaagccggccgcccccccccccataaaaaaaggggggggggcgccccccccccccccccggggggggggggggagaaaaaaaaaataaggnngggggggggtaaaaaaaaaaaaaacccggcgcggggttgttttttttttttttgggggggggggggggggggtgtttttttttttaataaaaaaaaaaaaaaaaaanggggtggggtgtgtggggttttttgttttccctacccacc

SEQ ID NO: 86717 - protein, 102 aa, Zea mays
  misc_feature: Ceres CLONE 1573280
  misc_feature: SWISSPROT Homolog: EC 1.8.1.8 Protein-disulfide reductase
  misc_feature (35)..(35): Xaa is any aa, unknown, or other
  misc_feature (39)..(39): Xaa is any aa, unknown, or other
  misc_feature (60)..(60): Xaa is any aa, unknown, or other
MASEQGVVIACHSKAEFDAHMTKAQEAGKLVVIDXSLGXAWCGPCRAIAPLFVEHAKKFXSGVVFPEKVGTVGNQKVKGKVPPGALPKGAQRGNSQTFPIFG

SEQ ID NO: 86718 - DNA, 815 bp, Zea mays
  misc_feature: Ceres CLONE 1573281
  misc_feature (330)..(330): n is a, c, t, g, unknown, or other
  misc_feature (334)..(334): n is a, c, t, g, unknown, or other
  misc_feature (336)..(336): n is a, c, t, g, unknown, or other
  misc_feature (342)..(342): n is a, c, t, g, unknown, or other
  misc_feature (686)..(686): n is a, c, t, g, unknown, or other
gaaagctggagctccccgcggtggcggccgctctagaactagtggatcccccgggctgcaggaattcgtctcacccctagaaaaaaaaggctcacaatacccacctccatttagctactactactccctcgctgtcttccccaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggggggccaaaggggcggcncccnangtgacngcgccgcaggaacccacattgccagccaccggctccggcgctaccggcgcagcggcggtcggagtcaactccaactccgtgctggtggcgctgctggattcgcactacacggagctggcggaactggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaggtcgctgcaagcgctgctgctctaccacgtcctcccctcgcgcctgccctccgactcctggcccgcggcgtcccncccacactgtccgggcgaggaggtcgagctcgcccccgccgccggcgccggcatgcgcgtcggccacgccgccgtcacgcgcccgggacgcgtgctcaggcccgacggggtcatccacggcatcgagct

SEQ ID NO: 86719 - DNA, 766 bp, Zea mays
  misc_feature: Ceres CLONE 1573284
  misc_feature: Encodes the peptide sequence at SEQ ID NO. 86720
  misc_feature (504)..(504): n is a, c, t, g, unknown, or other
aaagctggagctcaccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtganaaaagagagaaacagagttcttcagtttgctatctctctctgcatgtttggcgtcagtctttgtgctcatgtacgtacgtgtgtctacctgcatgttggttgatccgattgcatctgctgtaaccatatattaatttgtccacgatgatatgatttgatactatatatatactaaaacccggacctcttattataaaaaaccgattgcaatagacacccctatgacatgcaatgcagtcatcatataattggggatcatcca

SEQ ID NO: 86720 - protein, 76 aa, Zea mays; identical to SEQ ID NO: 8464
  misc_feature: Ceres CLONE 1573284
  misc_feature (1)..(76): Pfam Name: Metallothio_2 Pfam Description: Metallothionein

SEQ ID NO: 86721 - DNA, 783 bp, Zea mays
  misc_feature: Ceres CLONE 1573285
  misc_feature: Encodes the peptide sequence at SEQ ID NO. 86722
aaagctggagctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttgggcacaaaactgctctcaggggtgggagcggcaaggttgtggacagtggccccaatgatcatatatttggttttctacagtgaccatgggggggccctggcgtcctttgggaatgccctacgtatccatatcctctatggtggatgaacttccgtaaatggtcctgaaaaaaagaaacatggctggccgggaacc

SEQ ID NO: 86722 - protein, 165 aa, Zea mays
  misc_feature: Ceres CLONE 1573285
  misc_feature (49)..(166): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGHKTALRGGSGKVVDSGPNDHIFGFLQ

SEQ ID NO: 86723 - DNA, 863 bp, Zea mays
  misc_feature: Ceres CLONE 1573294
  misc_feature: Encodes the peptide sequence at SEQ ID NO. 86724
aaagctggagctcaccgcggtggcggccgctctagaactagtggatcccccgggctgcaggaattcgtctcacccctagaaaaaaaccaaacagcgagcgcaaggaagaaaggtcgaagcgtcgtctctctcggcacggagcctagtgcccggcctcgtgagatccgaaattcagaatcgaggatggcgacgaccgcgactaggcggtggtggaggcggcacgacggcggcgacgatgacccagacgacctcgtccccatggacacccaagagcaagaagagctggtccggtctctggaggctaagcaggcgcagcaaggccgccgttggaggcgcgtcttcgcggggttcctcctaggttacgcggccttccttgtctaccccaatttccatcatgcttggtctccctgggagctgcggtaccatgcttacttcatggaagatttgcctgcacccatgggtcataattgcagattggatagctgctctagcatgcctattttggctgtgaaaggatttcctacagaattcagggcccctccaaagaaggggaatgggggtattccttgcctttgtggggctttttggggtagccaattctttttgggaacttacgtacagcccttgaaggtttcccaaaaaatttccaatggggatatgtttccagggggtccccacactcgggatccctttttaaagggccgggggcgcatttgaagcccctgttttgtttgaacccaatgtggctcgccgcgggactccaatgccctagatattcccagccccctctcggagaaaaggttcacccgggtacatacctttcgaaagggccctttgtagatatttcagaaaaccatgagctt

SEQ ID NO: 86724 - protein, 177 aa, Zea mays
  misc_feature: Ceres CLONE 1573294
MATTATRRWWRRHDGGDDDPDDLVPMDTQEQEELVRSLEAKQAQQGRRWRRVFAGFLLGYAAFLVYPNFHHAWSPWELRYHAYFMEDLPAPMGHNCRLDSCSSMPILAVKGFPTEFRAPPKKGNGGIPCLCGAFWGSQFFLGTYVQPLKVSQKISNGDMFPGGPHTRDPFLKGRGRI

SEQ ID NO: 86725 - DNA, 778 bp, Zea mays
  misc_feature: Ceres CLONE 1573302
  misc_feature (631)..(631): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
aaagctggagctcaccgcggtggcggccgctctagaatagtggatcccccgggctgcaggaattcgtctcacccctagaaaaaaggggattgctactaggcgggcgctagcactgcgaagcatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgactccctctgcgccctcgccctcctccccttcctccccgggcacgcccgccaccccgtcgcctccatcggacaccccgtcgccgccgtcgtccggtggaagggggcaggtccccgccgtcgtctggggggtgggcgatccacgccgtcctcccactcgcctccaagccatcncgggggggggggcggggggggcgnnnccttccggggccgtctacgtcgcttcgtcgtggggcggtggcccctcgggcggcctccttgctgctggctgctccgccagctttcatctggccttcttgctggtctccgccaagaaagcgc

SEQ ID NO: 86726 - DNA, 965 bp, Zea mays
  misc_feature: Ceres CLONE 1573303
  misc_feature: Encodes the peptide sequence at SEQ ID NO. 86727
  misc_feature (8)..(8): n is a, c, t, g, unknown, or other
  misc_feature (60)..(60): n is a, c, t, g, unknown, or other
  misc_feature (61)..(61): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttttgnttggggggggggggtgtatatataattttcagcaagagcaaggggagagaannttttnnnnnnnnnttgcaaagctggactccccgcggtggcggccgctctagaatagtggatcccccgggctgcaggaattcgtctcacccctagaaaaaagggattgctactacgcgggcgctagcactactaagcatctcgcctcatcgtctcctccgtgctccacttgcccattcttacgcgctaagcaacaagccaaccggccgtagctccaaagcgggagccggagccggagcccggagctaaggggggccgagatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtgcccagccgcgccgccgccgtcacccccctacgtcccggcccccgcgccgtcctccaccccggcgactccctatgcgccctcgcacctcctcccctttccctccccgggtcacagcccgcccaccctcaatttgcctccaatggggaacacacccggtcagcccgtcctgacattcccggttggaaggggggggcaagggttccccccgcacccgttccattatgggggggggttgggggccaaattccaacggccccgttcccattgccaacttgggcccgtcccccaatttccggcaacttcccccccggggggggggccccgggtcctacctaaaagtggagcccaggggcggaccccggtggaaaccctgggagttcattttctgtcccgggtttggcccccctggggtctcggggtttaacaatttcccttggcgcaaagcttttagggggccttgcataaacggagaatcccccaaccgaacttttggt

SEQ ID NO: 86727 - protein, 91 aa, Zea mays
  misc_feature: Ceres CLONE 1573303
MGGGWGPNSNGPVPIANLGPSPNFRQLPPRGGGPGSYLKVEPRGGPRWKPWEFIFCPGFGPPGVSGFNNFPWRKAFRGPCINGESPNRTFG

SEQ ID NO: 86728 - DNA, 795 bp, Zea mays
  misc_feature: Ceres CLONE 1573304
  misc_feature: Translation starting site: 214
caaagctggagctccccgcggtggcggccgctctagaactagtggatcccccgggctgcaggaattcgtctcacccctagaaaaaacccatctccctctgctccgggcgcaccgtcaccgggtgaggctgtattgcgtcgacagcaacacctgctttcgctacgacgggagcaccagaggctaggcttgcttcatcagtgacagggagccaagatgccggccggagggttctcggtctcggcgccgtccggcgtcgagttcgaggctaagatcacgccgatcgtcatcatctcctgcatcatggctgccacaggcggtttgatgttcggctacgacgtcggcatctcaggtggtgtgacgtcgatggacgacttcctgggcaagttcttcccggcggtgctgcggaagaaactggaggacaaggagagtaactactgcaagtacgataaccagccgctgcagctgttcacgtcgtcgctgtacctcgcggggctgacggccaccttcttcgcctcgtacacgacgcggcgcctcggccggcgcctcaccatgctggtcgccggcgtcttcttcatcgtggggggtgaatctcaacggcgccgcccagaaactcgccatgctcatcgtcggcaggatcttgctcggctgccgcgtcagcttcgccaaacaggccgttcccctgttcctgtctgagatcgcgcccaacaggatcccgcggcggctcaacatccctggttcagcctcaacgtcaccattcgggatcctgtttcgcaaacttcgtcaactaccggacgt

SEQ ID NO: 86729 - DNA, 788 bp, Zea mays
  misc_feature: Ceres CLONE 1573305
  misc_feature: Encodes the peptide sequence at SEQ ID NO. 86730
caaagctggagctccccgcggtggcggccgctccagaactgagtggatcccccgggctgctggaattcgtctcacccctagaaaaacttccctgcccccggtgagctgccactgccagcttccccgtgcgcgagctgtgctgctgctcggcggcgcgcccactccccggccgctctctcgtcaccccgcctgccggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtatacggatcatctacggtatcgatgcagtgcatgggcacaacaacgtctacaaagctactattttccctcacaacgtcggggcttggagctaccaggggaccctgaacctccgttaagagaaattggaagaagcaacctgctctttgaaagttagaagctaactggggattcccttaaccgcctttggctcccctggtattagcggggtttgt

SEQ ID NO: 86730 - protein, 147 aa, Zea mays
  misc_feature: Ceres CLONE 1573305
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMQKGALSTRLGIRIIYGIDAVHGHNNVYKATIFPHNVGAWSYQGTLNLR

SEQ ID NO: 86731 - DNA, 813 bp, Zea mays
  misc_feature: Ceres CLONE 1573306
  misc_feature: Encodes the peptide sequence at SEQ ID NO. 86732
atagctggagctccccgcggtggcggccgctctagaactagtggatcccccgggctgcaggaattcgtctcacccctagaaaaaagcgacgcgcatctggcctgcccatctctttcgtgctcctacccctcaagccttcttccgcccgccgcctcagccctcaaggcttttccttctcatcttcttctcagaccggggacgggcccgacggggacagggacaaaaggtggtgcgatcttgttgggcacactccgcctccgcgcgcgggaagagagagagagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcggttgctgaagctcctgctgacatcaacgtcactaccaatagctcctttgtgctggcggcagataggacatatcgaagggaccctttgaatggcttcaggaaatacccgggcggctggaatatcagtggaatgcactatttcgcttccgtcggatatacagccatttcgctgttcgccattgctctccggggggttggggaacctttttcccggatatagcttgggaatttgctgccggcattggtgttggcccgccatcccccctaccaagtttttccggaaaaggcatt

SEQ ID NO: 86732 - protein, 125 aa, Zea mays
  misc_feature: Ceres CLONE 1573306
MALPAPPVRLALLLLVALPFCAAHPGPGAFNAPRHFQTPALHSDGFGLVARRSVAEAPADINVTTNSSFVLAADRTYRRDPLNGFRKYPGGWNISGMHYFASVGYTAISLFAIALRGVGEPFSRI

SEQ ID NO: 86733 - DNA, 719 bp, Zea mays
  misc_feature: Ceres CLONE 1573313
  misc_feature: Encodes the peptide sequence at SEQ ID NO. 86734
ctggagctccccgcggtggcggccgctctagaactagtggatcccccgggctgcaggaattcgtctcacccctagaaaaaaaaaagaaccagagttacatgcttcaataaactcgtcagccttagatgtcaacacaagtgccacttcagaaacattttctgctactggcaatgttgcccaggctgatgctaagaacactttccagcctccatctcaagtgaaacatggttggggcggtgttccaggtcgcccttccatggctgaaatagtgaagatgggccggcctcaagctaaagttgggagcagatctgttgcaagtagcattgtcatgccagctattggtgattcagccattctcaatacaccaaatcttgcgcccaatgaatacaaccaaactgtatttgcatcagaagtaggccatggtgcagcagataaattgccaaatgttgccgatgaggtgcactctgtatctaaagatgcttcctcacttgatatgttaccttcagcagagggaacagatgttgaagccccttccatgagtgctaacatgcaaggttcatcaacgccagatgccaatgaagatgacgttgaaaaagacacaaatttggaagagggcaatacagaaagcttgacgactcctggacaagtttctgcttctggtaaagatctgaatggagatgtgtctacaacgacaacacaatttgatcatttgactctgc

SEQ ID NO: 86734 - protein, 154 aa, Zea mays
  misc_feature: Ceres CLONE 1573313
MAEIVKMGRPQAKVGSRSVASSIVMPAIGDSAILNTPNLAPNEYNQTVFASEVGHGAADKLPNVADEVHSVSKDASSLDMLPSAEGTDVEAPSMSANMQGSSTPDANEDDVEKDTNLEEGNTESLTTPGQVSASGKDLNGDVSTTTTQFDHLTL

SEQ ID NO: 86735 - DNA, 1059 bp, Zea mays
  misc_feature: Ceres CLONE 1573314
  misc_feature: SWISSPROT Homolog: EC 4.1.1.49 Phosphoenolpyruvate carboxykinase (ATP)
  misc_feature (12)..(12): n is a, c, t, g, unknown, or other
  misc_feature (13)..(13): n is a, c, t, g, unknown, or other
  misc_feature (25)..(25): n is a, c, t, g, unknown, or other
  misc_feature (51)..(51): n is a, c, t, g, unknown, or other
  misc_feature (57)..(57): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
gtggggtgtggnntgtgtgggtgtntggtggggtgatgggtggtggtgggngggggncggtgttgtgggtgggggggtgtggtctttcttaataactgccnnnggggaaaaactggagctcccgcggtggcggccgctctagaactagtggatcccccgggctgcaggaattcgtctcacccctagaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagtaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcaggtccatcagtgccgtcgttgggcgtctctggacgccgtgaaacccgggcccgaaaagtgggtcaaggggccgaccccgggcgggccaaaagggaagaaggcccgccccccgcaaggggtcgccgcccatttcaaacgccccgaagggggcggcaccccaagcaaggcaacccggcccaaaccccggggccgggcccccccggacgcatttcgcgccccgtttcaagcgcgaaacacggcccttccctttccaaagagttcccaccctcccaagggtggggcctccaaaaacaaaaaccattttttcagccccttgagcttgtgaaaccttgtttaaaccgaaagcccaggggcccctttccaagaggttccctaaaagaaggggggggtcccgttttccaattccaactgttcccacccgcggggcccccctttgggcgaaaaaccccggtgtctgggggtggcccaaaagacacgggggggggggttcttccccaagggggaaaaaaaggcgcgggtgcgggccaaag

SEQ ID NO: 86736 - DNA, 1115 bp, Zea mays
  misc_feature: Ceres CLONE 1573315
  misc_feature: Encodes the peptide sequence at SEQ ID NO. 86737
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (82)..(82): n is a, c, t, g, unknown, or other
  misc_feature (1115)..(1115): n is a, c, t, g, unknown, or other
gggggtnggggnnnngnnntgtggtgtggttttaattaaatgagaaaaaagcggctgtaattagtttttggggggggggttnaaaaactggagctcaccgcggtggcggccgctctagaactagtggatcccccgggctgcaggaattcgtctcacccctagaaaaaagcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgcctccgctggggccaacggcgccaactggctgggcgggctgagctgcgcgtcgttccgcaaggggttcgtgttctggactgcgacgtccgggtaccaggttgagggcagcggcgtccaccaaagggacgggggaccctacatggtgggagtcaattcccgcacgatcgcagaaaaagagtcgcgggggaaatccaaagagggaggacgttgggaattgggactccgaaaacccttgcgcctcccaagggaaagagacgtgccgagaaccacactggaaaacaagagttgggggagccgtggtggaagtgggcccgttaccctcgggggtgtcgttaggaacgtccgctggaaagggggggggggtggccgggtggggggaaatcttcttttgtctgcgcgacgaggaaaattgttggatcctcatacatagcggggggaaaaagaagagaggacgcgacaagtgtcccgttggaaaaacaggggttggaagtatgggccgcccgtagatgtgtataatacgaagtttaggggtctcgtggcggggagaaagtcttttccgcgcgcgtaggctactgtcgaaaaggacgatgggggaattttgggaaccctacaccggcgggatcaaagtgaaaacggcctcatgtgacccgcacgtcagaggggatatatcatcatgtcatcgcctcggggggggcaggtgagacaaacagagttgccatctcgtggcgggaggagtgtctttn

SEQ ID NO: 86737 - protein, 164 aa, Zea mays
  misc_feature: Ceres CLONE 1573315
MDARWAVLLALLVASGGVRVCASAGANGANWLGGLSCASFRKGFVFWTATSGYQVEGSGVHQRDGGPYMVGVNSRTIAEKESRGKSKEGGRWELGLRKPLRLPRERDVPRTTLENKSWGSRGGSGPVTLGGVVRNVRWKGGGGGRVGGNLLLSARRGKLLDPHT

SEQ ID NO: 86738 - DNA, 751 bp, Zea mays
  misc_feature: Ceres CLONE 1573317
  misc_feature: Encodes the peptide sequence at SEQ ID NO. 86739
  misc_feature (718)..(718): n is a, c, t, g, unknown, or other
catagctggagctccccgcggtggcggccgctctagaactagtggatcccccgggctgcaggaattcgtctcacccctagaaaaaggggttctccgttcccctacccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctcttttgagggagggggaagtaataaaagggaaaaagctagcaaggggatttccttgatcccatcatcgtgctacagatcctttagttctagcaaggaggaggaaaaagagagagcaagcccatggatcccagccagatgatgttccccatctggggggcgccgcctcccgccgccttgaagccgccctccgatgaccacgccgccgcccccaacgcgcaggcgcagcccttcctcccccctcccaatcccaaccgcggctggaagcgcaagaatcccgccgccgccgcctaccagccaccggccctcggcgatctccaggtgcagaaccgcgcctaggctcgccgctggttcaagaacagcggcggcggctaccccatacaaagccgcaagtttttctttccccaagaacaagaacaacaaggtcgccgcgcccgggntataacacctttcgaggcggtgccttggctacc

SEQ ID NO: 86739 - protein, 71 aa, Zea mays
  misc_feature: Ceres CLONE 1573317
MDPSQMMFPIWGAPPPAALKPPSDDHAAAPNAQAQPFLPPPNPNRGWKRKNPAAAAYQPPALGDLQVQNRA

SEQ ID NO: 86740 - DNA, 836 bp, Zea mays
  misc_feature: Ceres CLONE 1573318
  misc_feature: Encodes the peptide sequence at SEQ ID NO. 86741
  misc_feature (372)..(372): n is a, c, t, g, unknown, or other
  misc_feature (397)..(397): n is a, c, t, g, unknown, or other
ctccccgcggtggcggccgctctagaactagtggatcccccgggctgcaggaattcgtctcacccctagaaaaaaaggggcagcctgtactgcccgcttctagctgcagctaccctccagtcccagttccagccccgggcaggcgctcactaagtgcggagccgcactctcttcgagtcttcgctcatggtctctctctccaggtcgtgcaggacgatccatatcccggagctcttgcgcgagcgacatgtcctcggcggcgggcggtggatacggggctgcgggcggcgccgagcaccagcacctgttgctggggctggcctcggggcagctctaccacgtgccgcatcatagccgccgagagaagctgcngttcccgccagaccggggggactcncccccgcccactgcctggccggcgcctcgaccctgctactcctacgcgtcctcggcgaagatggtcctactcggcggagagcccaacggtgggcgacacacgacaagtagtgggggacacggcgctacctgcccggggccgggggcccaaatacccgagccaaaaaattttgagggtcctcgctcctcttcaggggatattcaataccctacgccccgcccccgcgagagaaaaagcctcccccgcggaggggttaaccgggggggccccttaccgggcccgttttcacgggggttccgagggccgtccctcgggcggggaaaaaagggttcccgggggaacccccccccaagaaagcaacttccaaggaaatacttgcccacacgaggagggggaaagggccccccgaaaggtgggtaaaaagaggcttctcagaaaa

SEQ ID NO: 86741 - protein, 189 aa, Zea mays
  misc_feature: Ceres CLONE 1573318
  misc_feature (42)..(42): Xaa is any aa, unknown, or other
MSSAAGGGYGAAGGAEHQHLLLGLASGQLYHVPHHSRREKLXFPPDRGDSPPPTAWPAPRPCYSYASSAKMVLLGGEPNGGRHTTSSGGHGATCPGPGAQIPEPKNFEGPRSSSGDIQYPTPRPRERKSLPRGGVNRGGPLPGPFSRGFRGPSLGRGKKGSRGNPPPRKQLPRKYLPTRGGGKGPPKGG

SEQ ID NO: 86742 - DNA, 733 bp, Zea mays
  misc_feature: Ceres CLONE 1573319
  misc_feature: Encodes the peptide sequence at SEQ ID NO. 86743
  misc_feature (645)..(645): n is a, c, t, g, unknown, or other
aagctggagctcaccgcggtggcggccgctctagaactagtggatcccccgggctgcaggaattcgtctcacccctagaaaaaacgcgcctcctctcgccctcgctccgccgccgccgccgccgccgcatcaagcacccgccccgccgtcgcctgaggtagacaccaatccgccgccatggggcgtatgcacagccgcgggaagggtatctcatcgtcggcgctgccgtacaagaggacgcctcctacctggctcaagaccgctgcctccgacgtggaggagatgatcacaaaggcagcgaagaagggacagatgccgtcgcagatcggcgtcctgctccgtgaccagcacggtatcccccttgtcaagagcgtcaccggcagcaagatcctccgcatcctcaaggcccatgggctggcaccagaaatccccgaggacctgtacttcctcatcaagaaggcggtggcgataaggaagcaccttgagaggaacaggaaggacaaagactctaaattcaggctcattcttgtggagagcaggatccaccgccttgcccgctactacaagcgcacaaagaagcttccacccacctggaagtatgagtcaaccacagcgagcactctggtggcctaagtgtggtatccntccgacagcttgttctagatatgaatttgtgtaatgctttattatgggctcgagcccggtttaaatgggacaacggaaccctcattct

SEQ ID NO: 86743 - protein, 151 aa, Zea mays; identical to SEQ ID NO: 52575
  misc_feature: Ceres CLONE 1573319
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15

SEQ ID NO: 86744 - DNA, 1053 bp, Zea mays
  misc_feature: Ceres CLONE 1573323
  misc_feature: Encodes the peptide sequence at SEQ ID NO. 86745
  misc_feature (11)..(11): n is a, c, t, g, unknown, or other
  misc_feature (36)..(36): n is a, c, t, g, unknown, or other
  misc_feature (59)..(59): n is a, c, t, g, unknown, or other
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
tggggcaggtnccccggcgcggggaccaaacaaaanccgcgttaagccgtgcaaaaaanacnccnnnccccaactggagctccccgcggtggcggccgctctagaactagtggatcccccgggctgcaggaattcgtctcacccctagaaaaaatccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcataagccccgggcaacagcagcgggatccccgtgctggtcgacgaagacgacccgctcgcactcgaatcggttctaaacatcactctggtgaacaaaggcaggccgctcccgtaagcttgaaagagggattggtatccagaagcctacttccgtggggcttgacgtaaccaggggcaagcgcttcggtggccttcctcaaagaagattaagggcccgcaacgtttcctcgggtccggcgaatcttgtgttactaaccggagggagcccggtgggggggaaacgaaggttccggggcatcccgtgtctgagtcaaggcggaaaggcggggggaaccactttcgccaagggggccaaaatgaaaccggggtctgggtaggcccgggcgaaatgggcgaaaggggggggaaggaatacccgggggggggtccgcggtggctatgggggctagagcgcagaaagaaacttccgaacctaagggcccactccgccgtagggatatgtatcccgggagtctccaccaacggggaccaaaggcatttctcccaataaaaagaaacttatcaagtccaggggggactac

SEQ ID NO: 86745 - protein, 130 aa, Zea mays
  misc_feature: Ceres CLONE 1573323
MKGGTQAVSLMVHLAVPWLCLASWAALLPALASGNVGAAAPILRADYIKLNFSTASATPDKYKSFIASVRAGLVSISPGQQQRDPRAGRRRRPARTRIGSKHHSGEQRQAAPVSLKEGLVSRSLLPWGLT

SEQ ID NO: 86746 - DNA, 1282 bp, Zea mays
  misc_feature: Ceres CLONE 1573326
  misc_feature: Encodes the peptide sequence at SEQ ID NO. 86747
  misc_feature (21)..(21): n is a, c, t, g, unknown, or other
  misc_feature (45)..(45): n is a, c, t, g, unknown, or other
  misc_feature (52)..(52): n is a, c, t, g, unknown, or other
  misc_feature (880)..(880): n is a, c, t, g, unknown, or other
  misc_feature (957)..(957): n is a, c, t, g, unknown, or other
  misc_feature (1183)..(1183): n is a, c, t, g, unknown, or other
  misc_feature (1282)..(1282): n is a, c, t, g, unknown, or other
tattatgaagataaaaaaatntgcgggggcgggggaatgcggttncccaaanaaaaaagggaggagagaataactggaactccccgcggtggcggccgctctagaactagtggatcccccgggctgcaggaattcgtctcacccctagaaaaaagagcaccaaggaccttcggcgcccgttcaggatccacatcttcccgagcgagttcttggttgacctcttcccccttcggaccacctccaaggctcttggtgtagcttgccactctcaccaatcaagttttcatgtctgatctcgacgttcagatcccaactgccttcgatcccttcgctgaggccaatgctggggactctggtgcggcagcagggtcaaaggactacgttcacgggcgcatgcagcagtgtaatggatcgaagagcccgactactgtccagggattgaagaaggagttcagcgtacagcaagatcttgaaagatctcaagaaaagagttctcgctgcaatggtaacagtgggtcgaggacccctgaaacttgggacagggtgcgtccaggcacccagggggggattacgaagggagggaaccggccccgggaaattttccttcttccccggagaccgggactttgttttgagagaaagggaagccccagtccagggaaattccctaggggttgtccgcggaaggaaaaccccgaccgggaggtacccactcaagtcacagaatctaaagcgtcctcgtttcagtgacagagaggtgcgccgaaggccccttgactgtaaacaaggtgcagtgcagacaaggatctgttgtgaaacgagtgttgtggacgaactcccagtaatatcactacaaatggctaccacggctagtgttggngctagagtgggggcaagaaggaagagcgcgggcctcgtgataaagtacaacggagctcgagtgcactaggtggcgcncgcgttataccccccttccccgggcataatgcgcccttccttgttcatatgggggagctcgctcaagtctcaccaggcggcgggatggtgaagtgggtctgttggacgtaaacactgcggacagctctgtggttcacgaaaaaccgctctagggggacggtgtggcgcgtgtgggggatgcttctcagtgcggaaaaaagccctgttctatacatggcgcgtgggnaggcgggtgccgagtggaagtgtggaggaaaataggtgtattagttagagatgaacaatcgcgcttgacctgttgtgggcgcaagagctgttcagcgan

SEQ ID NO: 86747 - protein, 154 aa, Zea mays
  misc_feature: Ceres CLONE 1573326
MSDLDVQIPTAFDPFAEANAGDSGAAAGSKDYVHGRMQQCNGSKSPTTVQGLKKEFSVQQDLERSQEKSSRCNGNSGSRTPETWDRVRPGTQGGITKGGNRPREIFLLPRRPGLCFERKGSPSPGKFPRGCPRKENPDREVPTQVTESKASSFQ

SEQ ID NO: 86748 - DNA, 1254 bp, Zea mays
  misc_feature: Ceres CLONE 1573327
  misc_feature (57)..(57): n is a, c, t, g, unknown, or other
  misc_feature (903)..(903): n is a, c, t, g, unknown, or other
  misc_feature (1035)..(1035): n is a, c, t, g, unknown, or other
cggcgggccaagccctgtgtcatctcatctccttatccaccacgcccccccggtcgncccctcgacccccgaatgagaaggtggggctccccgcggtggcggccgctctaaaatagtggatcccccgggctgcaggaattcgtctcacccctagaccccggcagatctcgcgatcacgcgcgtcacccgaaaagggaatcgggttaagatttcccgacccgggacgtgccggcagacggagacaaaaggaagtcctgagacgccggcgggggccttgggaagagttatctctactgcttaacgggccgccaaccctggaatcggttgagcgggagggaggggatagcggccggaagagcaacgaacacaccgacgtgaccggggcgcccgcggatgcgcgtgaaggtccggaggaccgagtcccgtggcatgcccgggggcaagcatgagtagagtagggtctccgacgcggaacagccagcgcggccatggaactaaaggttggcagggggcacctccggacaagctgagtccgttggcgacggcggcacaaggatcggacccccagaagggccgggggctaaaggggggttcgccgggcgccccagaaatccctactggttctccgggtggggacatgggacgtaagcctcgactgcccatccgggccgctatgagcacggcggcttgacgccaggagatccagcgccctggaggcgccgacgtggtccttaagtgtggataccatgacacgcgccccacacgcagcgacggttacaatatatcttaccgccgacgaggaatcgggtagaaacagataacgcggggaagctctcaccaaaaagaggcgaggcgcgtaagagggtaacatagagcgggggagcgatatagtacctatgccantcggctgtctgaataataatattgtgtgagtggaagtatttctcgatcctccccagtataatgatcggtcaccgcgccaggggcggtcgatcacgggacgccctgggcattcgacccaaccagagtaaggancagtcaacagggacgggatcctcatatatagcgtccagccagccggatagaaatgtagatcgtgcgccgattggatagtactgcgaacggcatggaaaataacaacaggaaggtattataaatattgccagtgaccgtgagtcccatgggaacggcacctgtccgcgaaggtggggccgcacgggtataggagaaggttactgccacagcgaagcagtg

SEQ ID NO: 86749 - DNA, 1223 bp, Zea mays
  misc_feature: Ceres CLONE 1573332
  misc_feature: Encodes the peptide sequence at SEQ ID NO. 86750
  misc_feature (12)..(12): n is a, c, t, g, unknown, or other
  misc_feature (45)..(45): n is a, c, t, g, unknown, or other
  misc_feature (63)..(63): n is a, c, t, g, unknown, or other
  misc_feature (71)..(71): n is a, c, t, g, unknown, or other
  misc_feature (781)..(781): n is a, c, t, g, unknown, or other
  misc_feature (988)..(988): n is a, c, t, g, unknown, or other
  misc_feature (1029)..(1029): n is a, c, t, g, unknown, or other
gaaagaaggganttttgaaaaaaagggcgcggggggtatcacatnggccggtaagggaagagnagagaaanaaaaagctggagctccacgcggtggcggccgctctagaactagtggatcccccgggctgcaggaattcgtctcacccctagaaaaaaaaactgctagcagcgtcagcgcccgaccaaatttcccccctcacctcccgctctcccgtcgtcggcatggccaccgacgtgctgcgcgcgcgcaacatcctcttgccggcgccgccgcagaggatccgggcggcggcggcggcgggccggagggcagctggtagcgacagccgccggcccggcggcaccggcaccaggaggaggtcgccggacggccgggacatcgtcccccgcggtggggcgaaaacaccccgccggcaggagggtcaggtctgcggcggaagagtacgccggcgcatcggtctcgacgtcccccggacccgagcaggccgggggctacagcaagtggatgcccagaaaggccttggtcccgggcccgtgatgaccgccggtcggaagacagctgcccggaataaatttgcacctcagggtttaaacgaggggcgacgggaggtgggccctttcctgggcgcgcgtagggctggggaggggcgaggggtgtgtaaacggccgggggcatgtgggaaatgtgcgtagagtagataaagatgaggacggacagacggttgtggtgcaaacggagtaggttggagagacgagaggagtagctcagttgggaggcngaaagcgcgagatgacaagtgtataacatatcacaaaagagacttagtgacaataggaaagaataaattgtattgttggagggggggggacagtgcgggaccacggaggaaaaatgaggacggggtagctgatgatgtcagcatttataaattggtgtcttggctgagtcttaaagtgtgtatgtgcggcagcgggtgactggatantgtcgtcaaacatggagggggtgaggaaattgcggaggttntagatgaaaggggtgagaaagtggagcgcgtgcgttgcaatgaccgtgcggatgctgcggctagcagagacggaagcagagtgtgaaggtactgggagagaagcaaagcgaagctcggattcgttgccatcgcggacggcgaaccgagggattaacgagcgagagaacaagagaaccatgatgagggtgtgttg

SEQ ID NO: 86750 - protein, 156 aa, Zea mays
  misc_feature: Ceres CLONE 1573332
MATDVLRARNILLPAPPQRIRAAAAAGRRAAGSDSRRPGGTGTRRRSPDGRDIVPRGGAKTPRRQEGQVCGGRVRRRIGLDVPRTRAGRGLQQVDAQKGLGPGPVMTAGRKTAARNKFAPQGLNEGRREVGPFLGARRAGEGRGVCKRPGACGKCA

SEQ ID NO: 86751 - DNA, 1333 bp, Zea mays
  misc_feature: Ceres CLONE 1573335
  misc_feature (1)..(1): n is a, c, t, g, unknown, or other
  misc_feature (2)..(2): n is a, c, t, g, unknown, or other
  misc_feature (22)..(22): n is a, c, t, g, unknown, or other
  misc_feature (1133)..(1133): n is a, c, t, g, unknown, or other
nnggggggggtaaaaaatgaanacaaagccccgacccatcaaccttggtgggacataacaacacacaaaaaaaaactggagctcccgcggtggcggccgctctagaactagtggatcccccgggctgcaggattcgtctcacccctagaaaaaattgatcggacggccgaaaagcaacgataccccttcggcctgggcgttttgcgtaagagaccccgagaaataactgaatcaacccgcagtccactaggattgttcactgagtctaggataacttaccaggaggcccctgtcttctctagaaattgaggcgcagtccagggagttaagaaatcaggaaaattaatttagaaatggatttttaatatgaaaataatggctagaatttgcttagtgagcagatatctcaaggtgcgttctaattaatgggtcggagtttatatacttttaggaaggaagcttgcgtggcaaggggaaggtccccctttgggcggagaagccaggttcgaagaacctacgttcccctggttgcgcgggggcatacgtatcgtcaactggatgggggaggaaataggcttccctgaattggagacgagcggcagaacccatggcggcaaactggcccggagaagtccgtccagagagttgagaaatggcggaagtgtgaaacgtggtgtccatagaattgggaggcctgagaggcccgagcgggtctagtgggtggagataagtaacagaaaagtcggtggtcttgagcaaagctcaggtgtctctcatggaggctactccgagtggagagtgtgaggggaagtggatgaggggggagggacacaacgaaagagttgagagggatgagagaaattactaaggagaaggatggaggaatagaggggcggtgagtaattggcgtgtgtcggtgtacgcggcgcaatgaggagtcgatcggcgattgattgttttcagggtataagagacgcaggtaggggggagaggagtgatttgtgatatgccgagtatctgcggtggaacaagttgaacttggaatcggaaaagggtgatctgaggaaaggagaccatctatgaaggggacgagagatgggggtagacatgtccgacgacgtcgggggtggcgntaagcacgctcgtttttgtaagaacatgttgacgagcgggctggagaggcagatagaggccgtcgcggcttagcctatggacgaccgtgcctcggggatacagtgtataggcgcgatacagggcattacgtgtgacgtcggggcatgtacgactgtgatgtatcggggaagtgtttctaattacacgatggtgggagggg

SEQ ID NO: 86752 - DNA, 1329 bp, Zea mays
  misc_feature: Ceres CLONE 1573345
  misc_feature: Encodes the peptide sequence at SEQ ID NO. 86753
  misc_feature (63)..(63): n is a, c, t, g, unknown, or other
  misc_feature (860)..(860): n is a, c, t, g, unknown, or other
  misc_feature (1040)..(1040): n is a, c, t, g, unknown, or other
  misc_feature (1329)..(1329): n is a, c, t, g, unknown, or other
taacaagggtgtccgcgcgccacaccagccttttcccccgcctgcacaagccccccccccttntttggtccccccaaaactgggactccccgcggtggcggccgctctagaactgtggatcccccgggctgcaggaattcgtctcacccctagaaaaactccgcccccctcgctagcctcgcggagccgccgcacccagcgaccctcccgaagtctaacccttgatccggaccggccatggcgtcccgccgggtcgtctccgcgctccttcgctccgcctcccgcctccgtgccgcctcgcccgccgcgccgcgcccgctcggggcggcgtaccgcccctccccggccgggtacctctgcgaccgcaccgccgccgacggctccgccacggcggcccaggcggcgcccgtcactccgtcgccggcaaccgtgaagaccggcagcggccagataaccgacgagttctcggggggcgggggccagacacaacggggggcccaggtggaggcgcgctcatgggcgtacgatgccctgacgaaaaaaggggcgtcccagcaccattgccgccccggtatacgtcacgaggggtatcccacccgcacaacgacggccagaccctccatagtcatcctattgatggggcggccagagatccccattgagggtgatagacgaggagtggggcggggggagcggtcgagagtggcgggtgaaagaagaaccacagcgaagacccggaagtgtgagtggcgcgcgcgcggggctcaaataagactgcctcccccttgacccacccgcgatttagcatgtgtgatgacaccaggatgagtgtgtgcacacgagcataagaagacacaganacttgataatgacgacgcaggagccgcagcagacgagtttgcggggcggaacatagggggcaggtgcagcgcgtggacccgtctgtggtggaagtgagatgagggatgcgtcctagaaaagaaaacttatagggcactcatccccatgttccgcctcgataacacagcagttgcacagtntgtgccctcgactagctgcgtgggtgagtacatatgaagataccgactaatcgcgcggcccccgtcgtagatcgcggccgtgtgagcatggccgcgagcacgagtttggcgggccaagagtatcattatacgggcgctctcagccatctattccaaaacagcggtgacacgcgcatctcagatgctgatatacgagagcgcccgctccgtagatcacacgagagccggggattacactcagtgcgcgcgagagaagacacctcacacgttgtacaacatgcgtggagan

SEQ ID NO: 86753 - protein, 183 aa, Zea mays
  misc_feature: Ceres CLONE 1573345
  misc_feature: SWISSPROT Homolog: EC 3.6.3.14 H(+)-transporting two-sector ATPase
MASRRVVSALLRSASRLRAASPAAPRPLGAAYRPSPAGYLCDRTAADGSATAAQAAPVTPSPATVKTGSGQITDEFSGGGGQTQRGAQVEARSWAYDALTKKGASQHHCRPGIRHEGYPTRTTTARPSIVILLMGRPEIPIEGDRRGVGRGERSRVAGERRTTAKTRKCEWRARGAQIRLPPP

SEQ ID NO: 86754 - DNA, 850 bp, Zea mays
  misc_feature: Ceres CLONE 1573347
ctccccgcggtggcggccgctctagaactagtggatcccccgggctgcaggaattcgtctcacccctagaaaaattcaccgtgggtcgcatggaagcggaggcgacggtcgcgagcatcacgcacggatgggggcaggcgatagcacggcatgcagacgcccaagtccagcaatgctggggcatcacgagcgggcgggggtaccgcggcgtgcgtcacggggacggggcgggcgcacgggcgggcatcgcgatgacgggtgcgggagcaggcgggggcacgcgaatcacgggagtggagccacggtggtggtggacgccctcgttagtgtcttatagagtagtagagatagagattgtaggcgtccacaattcccagtggcgcacggttctgctgtccctccatcctcccgcgctccctccgtgctacatcaacgcccgcaggttctgcctctccctgtcactacgccgcctgcccccgccgcacccctccccgttactaggtgcggcgccgcgccgcgccgcctcctcggcctcgcctccgcgctcgccgacgactcgtcctgctccgacctcctcccgctgttcccagtccccgccggctacgccgcctctgacgccgcggatccccgatgccgagagctgcccgtcgcccgctgccgtcagcagcgtcttcagtaaagttccgcgacccgggcgccatctcctgtgaacccctgacgaactctgcggcgggccccttgaccaagccccaaggaatcctgggctttccaacgattgacgaacagttttccgacctccggaaattctatttcttggggccgggggtccccaacctagaaggggccgggc

SEQ ID NO: 86755 - DNA, 903 bp, Zea mays
  misc_feature: Ceres CLONE 1573349
  misc_feature: Encodes the peptide sequence at SEQ ID NO. 86756
  misc_feature (903)..(903): n is a, c, t, g, unknown, or other
tgagctcaccgcggtggcggccgctctagactagtggatcccccgggctgcaggaattcgtctcacccctagaaaaaaagggaggtcgggtcctctccccctttcgacagcgtcagaaacaggggagggggaggaagggtagcatcttcccccttctgaccacctccaacgctcttggtgtagcttgccactctcaccaatcaagttttcatgtctgatctccacattctgatcccaactgccttctatcccttcactaacgccaatgcttgggactctggtgcggcagcacggtcaaaggactaccttcacgtgcgcatccagcatcttactgctcgcaagatcctcactaccttccagggattgaacaatgagttcatctacagcaatatcctctaacatcccaccacatacttctgctgcaatgttacatttgctccaggacccagacacttcacaggtcattccccttccagtgttgatctctatgaaaaaccatcctctactttccttcatcccaggcccgcatttcttttaaatctcacccccctccatatttttccttttttttctcaatcctcccctcccttgtttcccttcatcctaccccatcccccttcctttcaatgtcccccccctcttctttctcccttcacttatccctgaacctcttccaaacccttatcccctttcttcagcttttccctcccttcgctcacccctcgcccctttttttacttttcccccttgcccccttttcccttcccattttttcccacatttttactgcccccccctccctccccgattcgattgccttcttcttaccttttcccctcttttctataacccttttttcttttttctcaggtgttttcccttctccctatctatccacatatn

SEQ ID NO: 86756 - protein, 62 aa, Zea mays
  misc_feature: Ceres CLONE 1573349
MSDLHILIPTAFYPFTNANAWDSGAAARSKDYLHVRIQHLTARKILTTFQGLNNEFIYSNIL

SEQ ID NO: 86757 - DNA, 875 bp, Zea mays
  misc_feature: Ceres CLONE 1573353
  misc_feature: Encodes the peptide sequence at SEQ ID NO. 86758
  misc_feature (725)..(725): n is a, c, t, g, unknown, or other
tccccgcggtggcggccgctctagaactagtggatcccccgggctgcaggaattcgtctcacccctagaaaaagcttcgtctccgtttcctccgcacaccaccacagccgcgtcaagccgtcaaccaaccaaaccctagaaggctctcgcccccgtccccaatccttcgccgctccccgatcctcgccgcccgcaggccaaaaccccacgcctctccctcgacgccgggtatatccagtgtaatcactttgtcagaaatgccttctgcatccaagtccaagtcaaaagatagatcagctgcaaaagttgcaaaagagcaacccaaggtttctgcaaagccactgggaaatggtacgcttgcaagttcttataacaacctctctggaaagttccatgttccccaaccatcagcttctttgttgggtagccaaggcatcaataaattcaggaataccgatgagatagatgaacattctcgcagctcccatggtacaggggatttcgattgtgcctccaacaacggtagctgctctgacgagtcagaagatccaaaggaaaaaccaactagtagtgtgtctcgagtagagtctggtcctggatgtgatattgataaacgagagaaaattcagacagaaaaatgagaagaagcatccaagacagaaagagaggcgtggccaaaaaattgcacgagcggttgtaagggttaatcttatgtctagaaaaantggaaggcacttgcgccaaaagcttggttgcgaatggggttttctccaccaaaatcaaggcaacgattgggccccttaaatacaaaaatgaaggggttgccgctttgaaagaaatcttggttaccctgggcttcctcgacaacctttggc

SEQ ID NO: 86758 - protein, 127 aa, Zea mays
  misc_feature: Ceres CLONE 1573353
MPSASKSKSKDRSAAKVAKEQPKVSAKPLGNGTLASSYNNLSGKFHVPQPSASLLGSQGINKFRNTDEIDEHSRSSHGTGDFDCASNNGSCSDESEDPKEKPTSSVSRVESGPGCDIDKREKIQTEK

SEQ ID NO: 86759 - DNA, 950 bp, Zea mays
  misc_feature: Ceres CLONE 1573356
ggagctccccgcggtggcggccgctctggaagtaccaggatcccccggagtctgcctgcaattaggtctcaccctctagaaaaatggacaccggctgcgtgcagtacggatagggagctgcacctctacctccacacgcactacgtgcagactagggagctttcacatgccctacacttcattcatgtggctctgacgccctattgcaggattagagggacaaccgctggttggacggtgcagacacaggtgtacatccagatgggggagaccgaggccgtttatccggacagggcgcatgctcatctgcgttaccgtcgttgtcgtcggattcacgtcagacatatgagctgctctaagggacacgaaggaaacttgcagcctcaagcaccgacctcctcggcacgctgcgatcgtctacattctgaggttgtggctccatgacttctcccacaatactgtgcagaacgcactgatgcaatgcatgcgtgacttcttccctcccattgctagggtcccagcacgttctttgaggggccgatcctatagtaaccatccttgggccccagtggcggccaaactcccattcttccagatcctttgggatcggcgcctcgagaaagcatttcctaaggactacttccctcccaggcatccaaggaaacaaattgggggaaccaggatgaagtttccccgtatcctataaaaaaccgaaatcttccttgcctggatgaacggcccctgtcgccagaaccttgggagatgggggcaattttccttgggaagggccggggcgtgatctcctaaagacccctggtcacccgtaaacggaaacacccccttgaatccttcgcacaaaagaagaagtgcctccttaacaagaggcgaattcgaaaaaaccgtgccgcgggcaaaccaaaagggccctgccgggggaaggttacagaaac

SEQ ID NO: 86760 - DNA, 862 bp, Zea mays
  misc_feature: Ceres CLONE 1573358
agctccccgcggtggcggccgctctagaactagtggatcccccgggctgcaggaattcgtctcacccctagaaaaactgtgtcccctccaccaaaaccgacgacgacgtcgctctcctccaccggtgctcggcgctctccctccaccagcggcggtccacagacgctcggcgagctccaccggcgggcgctggcggctggtcagatccgctcggcagtcatccacctggcacatcgggtagctcgcgcctccgttggcagtcccaccgccgcccggccctcccccagcgcccccggtgatccggaccgcacccgcttgctcggcctaacgaccggctcctgccccgccgcagccgaagctcccagcgtcctcctgcaggccgagctgaaggttcagcgcgccggtggagttcgacgacgaaactccgtcacgtcatacctctccgcctcccgtcttccagacgtctctaatcggggtcccagcgtctcggagaagaggagcagcacggcacggcagctgtggcgaggaaggctcctgtcccatcccaacccagttagcagccgcccaaggaggaggagatccaatcggcgtgcgggcgtccgcgggcccatcctccgatcaatttccaatctgcagtaaattttgctaggaatacaccttggtcaaaaatctggtttgcctctagagcgagcgaacccaaatccttggggggtggggccctttccgtcaggaggaaaccatccctttcgggaccaacaaacaaagagaatttgggaaccccagcccctctgttttcccccacccccccccttcctagaaattccccccagggttaaagggtggggtgggcccccggaaacta

SEQ ID NO: 86761 - DNA, 884 bp, Zea mays
  misc_feature: Ceres CLONE 1573359
  misc_feature: SWISSPROT Homolog: EC 4.2.1.92 Hydroperoxide dehydratase
ctggagctccccgcggtggcggccgctctagaactagtggatcccccgggctgcaggaattcttctcacccctagaaaaaaacaggccgctcggcccaatcgaggaatacgactcgcgcctggtggtgttcctcgacacctccttatacccggtgctcttcaacaactctctagtagataagacggacctctctacggagaacgttcatgccggccaccgagctcaccggcagctacatgcgtgctctcgtaccttaagaccgcagaacacaaccactggacgcgtcaatacgctcctcttataattcctgatcacaccggcggagtcacgatatctccaagttcctcgaggtgtatcgctaccatcttctatcttatgtagaaagagctagcctagaggactgcaaggtccacttctgccactacaacgacaccgaacacttctgcctcctctgccacgcgctgatcggacgcgacttcgccgagtcctcgctcctgggacacgagcccaagctgatcaccaagtctgagctgttcaaggttaattctctagtcaacctctgtctgcccaagcacttggaggaggacatgactccactcgttccggcatccgtaggccctagttcaaataagactacaaccggactggaatatttcttccgagaaacaggataagaaggttgtgaaaccaaaataaacctgccccgtggatcactactggaagtaagaaccttgaacaacatgcataatccaccatgtggagatcaaatacctaaaggggtttttaaacaaactggttctctttttcctcacgaaaggtttgctaagccaccttccggggaggggaagacccaacagacaaaactttgcataaaataatgtag

SEQ ID NO: 86762 - DNA, 866 bp, Zea mays
  misc_feature: Ceres CLONE 1573362
  misc_feature: Encodes the peptide sequence at SEQ ID NO. 86763
ggagctcaccgcggtggcggccgctctagaactagtggatcccccgggctgcaggaattcgtctcacccctagaaaaaaacacaaaaaacctcaccttctcattccttcaagcgtcagcagcaaaaccagagcttcccttcaacccagcaagaaaaccaagcgacctagttagcgcagcggcagttatttgtgcagaccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccctcacccggaggctccgcgcgcagggcgtgcgcgggccgccctacacgttcttcaccgggagcctcggcgagatcaagcggctccgcgccgagggcgccgccgtcacgctggacgtcgacgaccacgacttcatccccatggtgcagccccatctccgcaaatggatcgcgctctacgggcggacgttcgtgtactggaccggcgcgaggccgaacgtgtgcgtggcagacgtgaacgtggtcaggcaggtgctcttcgaccgcaccgggctctaccccaagaacctcatcaacccgcaaatcttcccgcctgctcgggcaaggggcttcgtctcaccgaacggggacgaatgggaaacgccaccgccaagggttgtcccacccgggccttttggcaagggaacaaagctcaagctttgaaggaccggcgaaccaaggttccgaaatggcccccccgcctctggagaggattcccccaaaggggggggaacgctcacagccttggcagagaagg

SEQ ID NO: 86763 - protein, 171 aa, Zea mays
  misc_feature: Ceres CLONE 1573362
  misc_feature: SWISSPROT Homolog: EC 1.3.3.9 Secologanin synthase
MGLAWMVAAAVAAVLASWAFNALVHLVWRPYALTRRLRAQGVRGPPYTFFTGSLGEIKRLRAEGAAVTLDVDDHDFIPMVQPHLRKWIALYGRTFVYWTGARPNVCVADVNVVRQVLFDRTGLYPKNLINPQIFPPARARGFVSPNGDEWETPPPRVVPPGPFGKGTKLKL

SEQ ID NO: 86764 - DNA, 988 bp, Zea mays
  misc_feature: Ceres CLONE 1573369
  misc_feature: Encodes the peptide sequence at SEQ ID NO. 86765
  misc_feature (26)..(26): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (66)..(66): n is a, c, t, g, unknown, or other
aaacacacaaggggggggcggggggnaataaaaaaacaagaaattccctccgccgcnnnncccaancccaccaagctggaactccccgcggtggcggccgctctagaactagtggatcccccgggctgcaggaattcgtctcacccctagaaaaactccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgccgccgccgtagggagcttgcagccgggggcggagaacctgcaggtgcaggactacaaggacgctaacatgtattatggtgcttacccggcttatgcctatggagcctatggtggctgggggagtacccatacctgaagccatgaatggagcacagaacaccaacctgcttggtaccctatgcctgacatggaactaatgggctatgcctcccatatgggaggtatgccaaaccaatgggggccaatggatgggttcaagaattttaatgggggtcaacaaaaaatttacccgtgtaccccgggtcgtaacattccacccaaaggcgaacaaggaaactcttacctgggccaaagccttggccatcccaaaggggtataaaggttgagaaaaaattggccctcccgggggcgcccgcaaaaacaagaaggaaatcctaaacacattgggatgttgggaatccagggtgtaaaaaggcctttgcaaaaatatttcaaaagtgcggggggg

SEQ ID NO: 86765 - protein, 100 aa, Zea mays
  misc_feature: Ceres CLONE 1573369
MAAVGSLKPGMETLHVQDYKDAPPAKAAVESLQPAMESLHVQDYKDAPPAKGVAAAAAVGSLQPGAENLQVQDYKDANMYYGAYPAYAYGAYGGWGSTHT

SEQ ID NO: 86766 - DNA, 800 bp, Zea mays
  misc_feature: Ceres CLONE 1573373
  misc_feature: Encodes the peptide sequence at SEQ ID NO. 86767
ggagctccccgcggtggcggccgctctagaactagtggatcccccgggctgcaggaattcgtctcacccctagaaaaaaataaagccgcgtgccggatcacgtatgccctggttaatagcgctgcaaatttgcatataggacttgctctccagtatatgggaagccatgcaaagattcacttcaaccggcgagtgatgcaactatgtagatacttggacattctttgagttcacatcggaccggaagagaatcgtttatctgctattctcgcgatttgtcctcactggcaaggtgtttctctcgtcttgcgccaccggaccttatcacgtaatgcttccttgtgattatgtccggacaaaagaaaaaaacatttgttgatgcatgtgacaaatatgctcagctggggttgcgcacactctgattcgcgtactggcttgacctggaaccaaacgtaatacactaaccggctctcaagcatatacaggaggccaatagctcacttgaatgacagggcacgaggaaagtatcgctgcaggcttgccaaagagcatataacatagcttgtaaattctacgtgtaagagctatacaagatcgcctccaggatggggtacgataaactatcaaaatactgaggcaatcatgaatcaacttcaggatgttcactggtgataaacaaaggactgccattcagattgctcttttgtgcaacttgatgtcttcagaacatggaagacagctcttgcatatcaatgagacaactcgagatgaagttgctagaagctcgcgaagtattcttc

SEQ ID NO: 86767 - protein, 47 aa, Zea mays
  misc_feature: Ceres CLONE 1573373
MFTGDKQRTAIQIALLCNLMSSEHGRQLLHINETTRDEVARSSRSIL

SEQ ID NO: 86768 - DNA, 1230 bp, Zea mays
  misc_feature: Ceres CLONE 1573375
  misc_feature (44)..(44): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (72)..(72): n is a, c, t, g, unknown, or other
  misc_feature (1007)..(1007): n is a, c, t, g, unknown, or other
aaaaataatatttatggtacacacaaacaaaagcaggcgggccnggactcttagggagannnnaaaaaaaanacaaagctgggactccccgcggtggcggccgctctagaactagtggatcccccgggctgcaggaattcgtctcacccctagaaaaaagaagacgcctccccgctccgcgttccccagcgccagcggtaaccccacccaactcctctgagctgtgacacagctgtcctcctccccccactccaggcgctcacacaccctccacttccttccacaggaatccgccgccataatctcctccgctccgctccaccccgcattgcaggattgcgccgagcacgagcaccctcctccccgaagcctcttctttgctctgctttcggtggtatggtgggatgatgaggaaggcggcagtgcagcctgtgtctcctcgtctgccacgccgccgtccgcaaaggagcgtcagtggtgggcgagtgcgaggccggggacaaggacatgtcgaaggaccccgaccggcaaggtacaccatccataaggcatgctgagaatgcttacaacatcggctgacatagctgtggaaggcccgcgggggacatgtaaggtaccgaacgcaagagcagggttttcaaccgactaaacaatggctggggggagcccagtaggtgaagagtaaaacaaattctcagccatgggcggatacccaatatccagcattagcaacagacattgacccccaccacctcagagggtgttacgcaccgctcgtgggcgcgcgtagttagtgggataacaagattacgagcgtggcgaatatgaaagtgggtggggggatctttattcctattatcaccgcccacaagagaacccacaacgagctctgtctatctacataatgaaagacggcagcgagcgacaagcttagtacgtcactccccgctggtgatgatcaacttggaacgcccactaagagtatctcggcatatgaaattcgtctncattagactagtgaatttgcaagaatgacgataacacgggtcaccgattgagggagtggattcggagcgcatgacagctgtaagagcggtgggggagacttctagtgtaattgggagagcaccgtataagacgaaagtggaatagaaagatgtccaggcggacgccgaagatgatgcatatcgcagtggattgcacgtcctattcaaccgggtggctcatatt

SEQ ID NO: 86769 - DNA, 1154 bp, Zea mays
  misc_feature: Ceres CLONE 1573382
  misc_feature (12)..(12): n is a, c, t, g, unknown, or other
  misc_feature (13)..(13): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (97)..(97): n is a, c, t, g, unknown, or other
  misc_feature (969)..(969): n is a, c, t, g, unknown, or other
  misc_feature (974)..(974): n is a, c, t, g, unknown, or other
  misc_feature (1154)..(1154): n is a, c, t, g, unknown, or other
atattaaaaganntgggtcgcccgggacagactgctcttccccacacccacctagtgccttcttcnnnnnnnaaaaannacaagctggagctcaccncggtggcggccgctctagaactagtggatcccccgggctgcaggaattcgtctcacccctagaaaaacctccccgctccgctctcccttgtcaagttctcagcaccggccaatccatcctcctccgcctccctcggttcggcctctggcctgcacaccatgaactctcgcttccggagcctctggagagccatggctggcgctttgcagccgccgtgccacctcggagctgccgcgtgtaccttgctcgctacacagccgctataggagctgagcgagtgcgtccatctatcggactcgtccacctccgactccctttgcaattcgcctgtctgaactcgtgttcttgatcctgcgggcaaggggcagaccaacaaggagacacttcttcttcttcgtgacaaccaataaaaaagcaacggcaaatggaggggacctcggtctgcacgtgacagtgaccacctagccatgggattcccggagccctttcggtgcggggttctcaaagttgggcccgactccgggtccttgaacatcttccccccgggcagggaataccgcctcaatcaaaggggcgggccccggggtccgggtacctcttggccccaaacctggccaacaagaattccccgcaacctcgcggacgcgcggcggttttactctcccgagggggtgcctttaaaagccccaggctattccccgtggggtggtccagcgccactgaggggaccgcttgcctacccacgcccggggggcagtattatgaaaagcgcctttacagaaccgcggcaattttcgcaaccccataagactcctcgctactaagggatttatctttcctctccttctctcttctgcacagggagacattcnccgcnaacttctctccacagagtgtctctcccttgtccatgagtgtcttacctggggggggtttcgctcatttcctgggtgagccgcaccagttgagaggtccgattctcgggtgctcctattatgcagggacgcccgcccgggtgagtgtggttattttcgtgtggcccccatcttttttcgtn

SEQ ID NO: 86770 - DNA, 1255 bp, Zea mays
  misc_feature: Ceres CLONE 1573386
  misc_feature (1139)..(1139): n is a, c, t, g, unknown, or other
aaaaagaaaaaccccccccgcgaacgttcaccaccaccactttcgaaagaggggtataaatataaaaaaaaaaaaaaactggagctccccgcggtggcggccgctctccaatagtggatcccccgggctgcaggaattcgtctcacccctagaaaaagttaagcaagcgtaccctctgaggtaaaaaatgacgaaaattgtcagataaatattcaccaccagagtcagggcgaaaaattttaataggagcaaaaaactgggtgtgaaccatggatgcaaaagacttgtaaatggaaaacaacttagagcagcgtttcatgaagtaaacccaggcataacggagaacgatcttcgataaaaatgacataatatttataatcatcttttgaaacaaattgtgcaggacccgaaattatcagagtaaatcatatcaaaacgtctagcagaatgagagtcattagtaaaatatggaagctatatctattgttccaagacgaaaaccctctaagctgaaaaataagactcaacaaagtggtatgaacctagacaaccctggacgttgatgaggacgtagaacttatctagcatcctccctcctggcgaaccaaacaacgaaagggaatacacataatgattccctaagtgggagttaacaaatagccaaactgggaagacacataaaatcggggaaagttcgggcctagcaaagaggtaaagagcgcggcaaatgggcttgttccgcgttaatgaggaggcaaacaaaggtgaggaaaaaagtattttactaaaccgtgggcacgagaagaagggatacactgtgagagcactccccccagagaggttgcaatgtaaggagtctctcgaaaatcgtagttagaggcgcacattccctgcggactaaggaaaacaagtaatataccctcgtacacccagaagtagggcagaaaagtgggtgaggcgaaccttgtggtaggtactcgtacataaaataaccgagaatggcccccgcatattttgtaacacattcaagaatacacaactgtcgtgggtagggcggggttccgtaaaaacgagggtggatagccttatccgtgtcttgtcgaaaaaagggaaggcgtgtcactagtattgttaacatncggttataagatattattgaagagaggtcacggctaaaagataggtaaaaatattgaaatattaataaggactggagaaaatggagaagcgcgcccacggaaaaaattgatccaag

SEQ ID NO: 86771 - DNA, 902 bp, Zea mays
  misc_feature: Ceres CLONE 1573387
  misc_feature: Encodes the peptide sequence at SEQ ID NO. 86772
agctccccgcggtggcggccgctctagaactagtggatcccccgggctgcaggaattcgtctcacccctagaaaaaatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcaccacggtgagggcagcctggagctggaggcgatcctggccgacgcgtccaagccgtgggcttggcgggcctggaaaagcgcccgcctggagctgccgactgctgctgcgggtggcgctgccggcggtggccgtctacatgatcaacttcgtcatgtccatgtcgacgcacatcttctgcggccagctcggcaaacctcgagctcgccgcctcctcgctcggcaacaccggcatccagccccttggccttacggcctcatgctgggtatgggcagacgacgtggaaaacgcttgtccaggcaggcggtacggcgacgcacaaagcacggcatgctgggggggcgtaccctgccaacgcttcgaacggtgcatgatacatgggccacccacccttggccccagaactcgtcagtctaccacgttcctcggaggaacaaatctgggatccccctttcggggtaggctgggacccgcaattgtcccgggggccggccgcccagtcctttcgtggtaggggggctccacttcccgactaaatcctcttgccgaaaagccgggcccaaattattcccccttttcaaaaaaatattcccttgattggcgcgctataacctaaccgatggggctcccccgatgggctccaagaattgtcgcccc

SEQ ID NO: 86772 - protein, 150 aa, Zea mays
  misc_feature: Ceres CLONE 1573387
MDSTTTAPLLQPSAASSKEGPGPAPAHHGEGSLELEAILADASKPWAWRAWKSARLELPTAAAGGAAGGGRLHDQLRHVHVDAHLLRPARQTSSSPPPRSATPASSPLALRPHAGYGQTTWKTLVQAGGTATHKARHAGGAYPANASNGA

SEQ ID NO: 86773 - DNA, 796 bp, Zea mays
  misc_feature: Ceres CLONE 1573388
  misc_feature: Encodes the peptide sequence at SEQ ID NO. 86774
  misc_feature (718)..(718): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
ctggagctcaccgcggtggcggccgctctagaactagtggatcccccgggctgcaggaattcgtctcaccccctagaaaaaataaatgaccctcgctatcgccgttcttgtttattctcgcaatggaccctctgtagaggatgattgagatggcggcagatgcagggcttctggggcgggttctgccaaataaggctaaacaacgatgttctctttatgcagatgatgcaggggtgtttgttagagcagataaagaggatctgaaggttttgaaaaagattctagaagtttttgaagggtgttcagggatgaagattaattttgataaaactgaaattttcccgattcgatatccccaaactctttggccagatctgatggatgtgttcccgtgcaaatactcaaaatttccggggaggtatcttggtctacctctacatgtcagaaacgttaggagaatggatgtccaaccgctaattgataaaattaataaaaggctagcaggatggaaaggtagactactctcaaaggcatgtagggaaaccttggttaaagtggtgctttctgctcagcctttaacggcctttcctgcgcagaaatggcttcttaaaagaattgacaagttaagaagaagcttcctttggaaaggtaatagtccaaaattttgtaatgggggtcattgtttgattaactggtccacaacttgccttcaagatanggggtatatgatccagctnnnnnnnnnnnnnnnnnnnnnnnnnnnnnnnnnnnnnnnnnnnnnnnnnnnnnnnnnnng

SEQ ID NO: 86774 - protein, 199 aa, Zea mays
  misc_feature: Ceres CLONE 1573388
  misc_feature (193)..(193): Xaa is any aa, unknown, or other
MIEMAADAGLLGRVLPNKAKQRCSLYADDAGVFVRADKEDLKVLKKILEVFEGCSGMKINFDKTEIFPIRYPQTLWPDLMDVFPCKYSKFPGRYLGLPLHVRNVRRMDVQPLIDKINKRLAGWKGRLLSKACRETLVKVVLSAQPLTAFPAQKWLLKRIDKLRRSFLWKGNSPKFCNGGHCLINWSTTCLQDXGYMIQL

SEQ ID NO: 86775 - DNA, 953 bp, Zea mays
  misc_feature: Ceres CLONE 1573390
gagctccccgcggtggcggccgctcttcaactagtggatcccccgggctgcaggtattcgtctcacccctagaaaaagtccctcttcctcttcccaccttccctcttgccttctccaatcatccctttctggctttctcctcccccctgagaccccgagtcctgccggattccgagatcccggaggcagcttcccacaggctcctctcactacggtagctggatcaaaccatcctgctctcctctcgacagaaaccccggacgaaaacccagccggacccagccctgttcgccgcgcgcgcggagcccaggccatgccagatctgcaagatccgcaccgacaccactactactatcaccaggaggatgctctcgagatctctcgcaggccgcggggacagaacaccgcctcggcggccgggtggcctgcaaagacgacggagtgccgagatgcgactgaacccggttgggggaaatgcaccctgtgaccgctcccggggtggagggggtcccagccccccagagcgtgagtaacggcgttgcgaaccagccccgcaaacaaggatggtccggtcacaattctccggggggcgttaaggagaacctcccctccggggggggggggggaaccttggagaggccttagtttggggaggccgccagggagcattccccttgtgggttcagagacccccacagggttggcccgcgggggaagttctttgcaattttcagagcccgcttctaattgggttaaactatttcttgcaccacgaaaacgcttatgcacaaagacaaagcatattggggtgggcggacgccttgcacgaataaattttatgcgccccaaaaaaacaagaaaagggttgtgcataaaagacgccccgcttggggcgcgcgtgttcacacctcataatgcaggggcgtgccgcgaagaagaagaagctcggcgcg

SEQ ID NO: 86776 - DNA, 1098 bp, Zea mays
  misc_feature: Ceres CLONE 1573396
  misc_feature: Encodes the peptide sequence at SEQ ID NO. 86777
  misc_feature (12)..(12): n is a, c, t, g, unknown, or other
  misc_feature (13)..(13): n is a, c, t, g, unknown, or other
  misc_feature (98)..(98): n is a, c, t, g, unknown, or other
gttctgttttgnncaccccctggggtggactttcgcggccgtcgttgcgaggctttctattgcgtaccgtaaaatatataaaaatggaagctcaccgncggtggcgggccgcgtctagaactagggggatccctccggctgcctgaattcgtctctacccgtagaaaaatcgactccctgcgcgccatgggccactgcaacgtcgaggtcgtcccggcctcgctcttccgggccatcccggccctcagatacgttctctacacctcgacgtaccacgcgattcaccacaccaagaaggaggccaacttctgtctcttcatgccgctgttcgatctgctgggtggctcaatcgaccgacgctcgtgggacatgcacatgaagatgagcacaagtgtggaccatgtgccggacttcgtgttcctcgcgcacatggtggacgtgatgcgagtcctgcacgggcccccttcgtccgggagagctttcgcctccacgacccttcccccttgcaacttcttccctgttgcccaatgagggccccttccgcccttcctccggcaaagcctcgccctggtgggggcctgggtcccaagaaccctttccgccaattctcccgggaatcctaaaccttcccggggcgaacggggggtttccacccacaaatctcggggcccaaggttcccccccaaaaaacacagggccgctccccaaagaacccctttctcttggcgccccctattttgggcccccgaaggaggaaaacggcgcccttctttaaatacatggcaaacaagaaactctcgtagaaaggtgggggaaatattttcgttataaagggggcccctcaaaaatgaagaataggtgcgggttttttaaagaggtgtccccctccaagcctctcttgtggcggaccccctctttataaaaacaaaaaaccacgggggtgggcgccctaaacatgggggcgcgcccctgtccgcaataattatttctggcgagaaacacaaaagagcgccgcctttttattgttgggagggggcgcccccctgttgtttacaatggggtaaaccccctcttaatcactcgggttgggtggtttct

SEQ ID NO: 86777 - protein, 114 aa, Zea mays
  misc_feature: Ceres CLONE 1573396
MGHCNVEVVPASLFRAIPALRYVLYTSTYHAIHHTKKEANFCLFMPLFDLLGGSIDRRSWDMHMKMSTSVDHVPDFVFLAHMVDVMRVLHGPPSSGRAFASTTLPPCNFFPVAQ

SEQ ID NO: 86778 - DNA, 841 bp, Zea mays
  misc_feature: Ceres CLONE 1573400
  misc_feature: Translation starting site: 375
  misc_feature: SWISSPROT Homolog: EC 2.7.11.1 Non-specific serine/threonine protein kinase
  misc_feature (841)..(841): n is a, c, t, g, unknown, or other
tcaccgcggtggcggccgctctagaactagtggatcccccgggctgcaggaattcgtctcacccctagaaaaattgcctcctcttccgcggccccgtcgatgggcttggctttaccagtggcgggttcccacacgggggctagacgccggcaccgctgaccccgtctacaccgaatcccccgcgcgatttaacccctcgcctcgctcgccgcctccgcttccatacaaccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacgacgccggcggcggcaagaagcccaaggagccgaagcagaagaagggtaagaagccgaaccccttctcgatcgattacaaccgctcggggcaggcgagcgcgccaaagctggtggtgctgcgggatcccacggggcgagttcggggttacctacctctgcacagaccgtgcctcaggggaggcgctggcctgcaagtctatctccaagaagaagctccgcaacgccgtcgacctcgaggacgtgcgccgggaggtggagatcatgggccacctccccaagcaccccaaacgtcgtcacgcttcaggaacccgtaccaaggacgacaatggccgtggaccctcgttcatggaagcttcttccaagaggcggggaagctctttccacccggcattcctgggccgcgggggaacacttaccactggagccgggn

SEQ ID NO: 86779 - DNA, 1333 bp, Zea mays
  misc_feature: Ceres CLONE 1573404
  misc_feature: Encodes the peptide sequence at SEQ ID NO. 86780
  misc_feature (11)..(11): n is a, c, t, g, unknown, or other
  misc_feature (18)..(18): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (1138)..(1138): n is a, c, t, g, unknown, or other
  misc_feature (1175)..(1175): n is a, c, t, g, unknown, or other
tttgagattanaaattangagacaagttcttttttcgaacaccgttttgctcaacannncctctnnnnnnncaaagctggcactccccgcggtggcggccgcttttcaactgctggatctcccgggactgcaggaatgcgttgcactcctagaaaaatggcgcgaacaactcccggctggagaaggcgtacatggcgctgcgggcgctgaagcacgccatcacggacaaccccaagaagctgacgaagaacaggctctggacccacatgtgacaactacttccgcctgttctgcgcgccggcgcccgactacccctgccagcgcacggtggcctccatggacctcaaccactgcgacctcacctggacgcaccccgaggagcagggactgctgtccgacctcgccatcggcaaccacaactcctatcacttctgcggctccttccccgactcgctctgatccctgcacctcgtccactgaggatctacttcagaaacaaccaagctctccggggccctatcccgcccgcagcaaccgtctgcatttcccataccttcgaagtaccatcgcacatcagggttttaaaccaactttactggcgagacaaggggtgaccgggcgagccaacaaatattccgtaccaaaaaaaatgttttctgaacaaccggactacatagtcatatctaaacggtagccaaatcacaaggcgtttacggtaagattatcaaaaccgccatcctctcctcccgtaaacaccaaacccgtttgtacacacccacgaaagggtctccactcatcacagggcgacggcggttctccacgagggtagagaaaaattcacacatttgggggccgcaattggcggttcacagccaaaaaaaatgcccatctttgtgctcataaattacaaagtgagggcaaataaacaaaaaccccaccacggaaaattatatcactatcctttccacccccctataaaacccacggcggggcgctatatgcgctagagaccgcaaaaaaacgatggtcggaaaaatctgaatacccccaatacggatccctgggttgaaaatttatatataagttctgctaataagcatcccaatcggtacacccacaacactatagggggaagaanaaaaattcgctctctctatcgccgaggtggtaatatncacacatggacccccagcaaaaataagttaggagagcgataaaagacctgtggagagatcaacatcttttcgcacctctctacagcgttgggagacactaacctaatgcctatgagaggagagagcacaatttatacacttggagacccccgtctgtc

SEQ ID NO: 86780 - protein, 40 aa, Zea mays
  misc_feature: Ceres CLONE 1573404
MDLNHCDLTWTHPEEQGLLSDLAIGNHNSYHFCGSFPDSL

SEQ ID NO: 86781 - DNA, 882 bp, Zea mays
  misc_feature: Ceres CLONE 1573406
  misc_feature: Translation starting site: 244
  misc_feature: SWISSPROT Homolog: EC 2.3.1.119 Icosanoyl-CoA synthase
acccgcggtggcggccgctctagaactagtggatcccccgggctgcaggaattcgtctcacccctagaaaaaaagacacacacgaacaccgcaccgcaacgtagccggctaggggaagagctctttccttcagctgtgccgtgcacaacgcatggcacgctggtttggtttgcatctcccccgccaagaaagacgctgccgtgagcgggctgagcgggaaggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcggcatggagctggcgcgcctcggccccggcgagcccctctcgctgaggcgctcgctggagctggacctggtccacatcctctgctcggaatccctggtcgtcttcgtcggcagcgtgtacgtgatggcacagcccaggccggtgtacctggtggacctacggctgctgaaagccccccgccagctgcccgcatgcccttcgccaccttcaatggtagcacacgcgcctcatcaacgacgacgacaagaacgtgcgctttcagaaccaagatccctgggaacgcctcgggggccttcggcgaagggaaacgtgccttccctccccgcaaaacaataaaatccccgccccaaccccaaatatggaagggcttcccggcggccgaagggcgcaggcttgggtaatctctgttccccccagtgggaggaaccctcgtcccccccgtaacgggggggtcttaaaggccccaaaggaaacattcgagaatttccgtcagaatgtggaaaaacgggcacggcccttt

SEQ ID NO: 86782 - DNA, 845 bp, Zea mays
  misc_feature: Ceres CLONE 1573410
  misc_feature: SWISSPROT Homolog: EC 2.7.7.49 RNA-directed DNA polymerase
agctccccgcggtggcggccgctctagaactagtggatcccccgggctgcaggaattcgtctcacccctagaaaaagttaagcaagcgtaccctctgaggtaaaaaatgacgaaaattgtcagataaatattcaccaccagagtcagggcgaaaaattttaataggagcaaaaaactgggtgtgaaccatggatgcaaaagacttgtaaatggaaaacaacttagagcagcgtttcatgaagtaaacccaggcataacgagaacgatcatcgataaaaatgacataatatttataatcatcttttgaaacaaattgtgcaggacccgaaacatcagagtaaatcatatcaaaaggtctagcagaatgagagtcattagtaaaatatggaagctatatctatgttccaagatgacaacccttacgctgaaaactagactcaacaagtgtatgacctaaacaacatgactttattagagtagacaaacgagatctacacaggtgaccaagacgaaggacacaatagatgctaatgcagcagaaagcacaggagccgaagtggtagtggttgaaggtaagcgcaaggtttcctagaggcgaggggaagctctacggcgacggccagtcccaatcatatcccacccttgggattgatagaataatcctccgtccatagggggactgtagtataaatagaggcccatagccttagcaataagaatgggtctaatgggcccttaacaggttgcaaggttgggcagtttttaatgtaaataaattgccagatatgtaaagtgtgcattctagatttttttgtttgccaatgtttggaaccaaaaaaattcca

SEQ ID NO: 86783 - DNA, 1058 bp, Zea mays
  misc_feature: Ceres CLONE 1573412
  misc_feature: Encodes the peptide sequence at SEQ ID NO. 86784
aatgagtgtaaaaaagaatcttcctccacacaaagggtaacccacaaatacccacccctctccctttcccccaaactggactcccgcggtggcggccgctctataacagtgcatcgctcgggtgctcgattctggctccctgcaagaaaaagcaccgggccgtacggccagatcttccgccccgacaactttgtcttccgacagtctggcgcagggaacaactgggacaagggccactacacagagggcgcagagctcacttgactccgtagcttgacgttctcagaaaggaggctgagaactgcgactgcttccaaggcttccaagtctgccattcccttggaggaggcactggatctggaatgagcacgcttctcatttcaaagatcatagaggagaaccctgatcggatgatgctgacattttctgtgtttccatcgcccaaggtgtcatacactgctgttgagccatacaatgcaaccctgtatgtccatcacgttggttgaacacgcgtaatgaaatgcatgggtccatggacaaccaaagcactttaatgaactttatgcctctccaaaactcctaaaccctgaacgacccccctaaggattttggcagaactatgaaaccccagcttttgaattcaaatcgcctaaacttaattaaaactgggagtgcttacacatttgggctcgacccatatctggactttttccccccagggaaaaccaggttttttaaaacttatttttgaagcctttgtccccccaaaagactttggggtgaggtcccaaagctcgtggaatattcgcgcaattttccctcttcccggttctcccacccgtttccctttcaatgtggcaattgggctcttttgggccgccccagaccttaacttcttgccgggtgttggcgcctctaccaagggaaagagtacccctctgggtgcgccccttccccactataaaccttttaaggcgttagaacccttagtttaaaatatactttgtgagagtagcccccaagaaaaaccatgtgcatggtgtattggaccctccctt

SEQ ID NO: 86784 - protein, 47 aa, Zea mays
  misc_feature: Ceres CLONE 1573412
MSTLLISKIIEENPDRMMLTFSVFPSPKVSYTAVEPYNATLYVHHVG

SEQ ID NO: 86785 - DNA, 1106 bp, Zea mays
  misc_feature: Ceres CLONE 1573417
  misc_feature: Encodes the peptide sequence at SEQ ID NO. 86786
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (37)..(37): n is a, c, t, g, unknown, or other
  misc_feature (870)..(870): n is a, c, t, g, unknown, or other
ctccctctatnnnnnttgtcgggcgcctaataattcncatacttatagggggcccatcaaacccacaccaccaaagctggaactccccgcggtggcggccgctctagaactagtggatcccccgggctgcaggaattcgtctcacccctagaaaaaaaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagaagtcgcctagccgggagcacataaaaatggccgaggtggggtactcaccgacgatgctccactgctggcgttccacataacaaggtggcagacaaatttatgcccactccccgggtgcagggtgcttgggtgtgggggcaaatgtgccacggaaccaaacctgatgtttccgggtggggtttttttaatggcctttttcctttccattcccgccccaatggaaaaaaataaaacccggccccccaaaactgtggagaaaccccccccccaaaaacacccatttaaacgcggaggggtaacccaaaaatcgcttcacatactagggtggccccctngggccctcctaagggtttgcccccaaaaatatggggaaatttaaacacctaagtgccaatgagaatattcgtggttttgtggaaaaaacttctttttatttgggccactccacaaatcccaagaaataaattggctattccaccccacataaaaaggggaaaatttatctttggaacgagaacaattctgatgggccccctggaaagggttggttcccacaaaattggtttttttt

SEQ ID NO: 86786 - protein, 87 aa, Zea mays
  misc_feature: Ceres CLONE 1573417
MASKQQQKQFLDEAMIKQPTPEEDREGAWPSVLTIIGFGFLTFNSFMAVYRSNGDVGSISFVVFSYLVLVLLFYCLRRFETTPPEVA

SEQ ID NO: 86787 - DNA, 887 bp, Zea mays
  misc_feature: Ceres CLONE 1573419
  misc_feature: SWISSPROT Homolog: EC 1.11.1.15 Peroxiredoxin
  misc_feature (887)..(887): n is a, c, t, g, unknown, or other
ggagctccccgcggtggcggccgctctagaactagtggatcccccgggctgcaggaattcgtctcacccctagaaaaaggcattgcagtacgtccaggagaacccagacgaggtctgcccggccggttggaagccaggggagaggtccatgaagcccgaccccaagggaagcaaagagtacttcgcggccgtgtagactcgccgtctttgagaagctttgctacgtttttgtcatggtgcccgctaagccccccggcagtaggttggagttttgcggagctcgcgtttttacaaatctctgtgctctgaaccgagcgtagtagcccccctttgctgttgtgcatcccgattgagtgctgttctttgccaccttgtttaatttcgtcacctgacgacataaggttcattttacacgtgattgagagatctcacctctaaaaaactgaaaaaaaaacaaaaaaataaaaaaagagaaaaaaattcaaaaaaagaaagagaagacaaaaacctgagtactgaaactatcgcacgaatttgccaacagttaacaggagttgggcccccccgccgcaaaaactgcaaataaacgcgtggggatccccactgcgggaagtttccgcaaggggcccccccgcccccccccactatttacaaagaagaagagggggcttacaaactttactctacatgggggggggggggttttataggcaccacagcgggcggggcggggggggttttcccccaaaaggacttcaaacaccttttggggggttgactccccccagggggcccctattatatgctaccaaaaaaaaacgccccctctttttggccccccgggggggtatttaataaccccccccgtatttattttccctttcctn

SEQ ID NO: 86788 - DNA, 774 bp, Zea mays
  misc_feature: Ceres CLONE 1573421
  misc_feature: Encodes the peptide sequence at SEQ ID NO. 86789
ggagctccccgcggtggcggccgctctagaactagtggatcccccgggctgcaggaattcgtctcacccctagaaaaactgcaccgcgtggaaaacgctctagaccgcgaccgcgaccaagacttccccgtccgcccgctccgtcctcacaggccacggccaacgagacaactcacagtaacgttaccagccacgacacctatgaggctatgacccaacgtcccaaccaagaaccaactactctgccagcctacgcagtaacgcagcagcaatcccaacccaagccttcgctggcgcgcgggtccaccccgagtcacgcctcccgttcccataccaccaggtctcgtctccggctttccgtcggtcgtcctcgtccgccccaatacttcgtggtaaaacctccgcgatttcccttccccaccggcccacccaccgcggcagtcgcctcccctcctacaaataacccccgatcctccacgaggacgggagtaccttctgcagcaagtagtgaccaggagcgagcagccgaggaaaggagtcaagcaatggagaaggccgtcgacaggcagcgggtcctgctgcgacacctgaaccccgccgcggcgtcgagccccgccccgcccgccatctccgcaagcgcgtgcgcggcgggggacagcgcggcgtaccaccggaggccggccttcgccgacgacgtcgtcatcgtcgctgcttacaggacggcaatttgcaaggccaagagagggggtttcaaggatacctttgctgaggaca

SEQ ID NO: 86789 - protein, 76 aa, Zea mays
  misc_feature: Ceres CLONE 1573421
  misc_feature: SWISSPROT Homolog: EC 2.3.1.16 Acetyl-CoA C-acyltransferase
MEKAVDRQRVLLRHLNPAAASSPAPPAISASACAAGDSAAYHRRPAFADDVVIVAAYRTAICKAKRGGFKDTFAED

SEQ ID NO: 86790 - DNA, 1130 bp, Zea mays
  misc_feature: Ceres CLONE 1573424
  misc_feature: Encodes the peptide sequence at SEQ ID NO. 86791
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (58)..(58): n is a, c, t, g, unknown, or other
  misc_feature (59)..(59): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (949)..(949): n is a, c, t, g, unknown, or other
ataaatggtaannnatttaattacaatacaccccaggcatcagaaatataacgtgccnnaaaaaaaannncaaagctggaactccccgcggtggcggccgctctagaactagtggatcccccgggctgcaggaattcgtctcacccctagaaaaaaggatcaaaaaccgaatccaacgctgcctagggtttggtccgcctttcccttacccaccccgcgacgcccacccatggccgccgccgccgccgccgatgtgcccgccgaggccgccgccatcgcgcggcgcctggcctcctgcaacaccggcacccgggagcgcgctgtccgctacctcctctccgacttcctgccggcctccgcgcggcgcctttccgccaccgacctcatcaagctctggaagggcctcttcttctgcttctggcacgccgacaagccgctctaccagagctccgtcgccacgcgcctcgcctccgccgtctccgccccgccgtcccccgccgacggcgccgccttccttgccgcctacctcaccacgctccgccgcgagtgggcacacatcggacgtccacccgcctcaacaaagttctaccctccctcaacccgccgggtttcctcccaaccacagcctttccttggctccttcaggcgcccaaactcattttcggcccccccggtccgtccaacccttccccacaggttacggggtttcccggttcccgtggggccaagaaaaaaaagggacccctatggaccttcccccgggaaaaaagcccccgaatacaaggcgactcccctctcctatgccccaggggcaactcctttccctaaggagagggcccttctcaggggttaaacccaaccggaacagtccccgcaaggggatattttctctcttagtaacacaaaaagcttacttttggcccctgggtgggctcccccccgggattanagctcctgtgacaagaaccggtgtcggaacacccccctgtcgcggggcattcccagaagatgctctaacccggggtttggcccaagaactcgcaagccgcaatcccggggtgaatgggggggactataagagggtaaaagcccagccccgttttttgtaaaaaggtacaaccctggaaaag

SEQ ID NO: 86791 - protein, 207 aa, Zea mays
  misc_feature: Ceres CLONE 1573424
  misc_feature (12)..(197): Pfam Name: Nop52 Pfam Description: Nucleolar protein,Nop52
MAAAAAADVPAEAAAIARRLASCNTGTRERAVRYLLSDFLPASARRLSATDLIKLWKGLFFCFWHADKPLYQSSVATRLASAVSAPPSPADGAAFLAAYLTTLRREWAHIGRPPASTKFYPPSTRRVSSQPQPFLGSFRRPNSFSAPPVRPTLPHRLRGFPVPVGPRKKRDPYGPSPGKKAPEYKATPLSYAPGATPFPKERALLRG

SEQ ID NO: 86792 - DNA, 839 bp, Zea mays
  misc_feature: Ceres CLONE 1573425
  misc_feature: Encodes the peptide sequence at SEQ ID NO. 86793
ggagctccccgcggtggcggccgctctagaactagtggatcccccgggctgcaggaattcgtctcacccctagaaaaagagtagcgcagaggcggcagggtgggcgaccagtctcctccgcacgcttcccaccgagctcacacactgcacactcccacactcccactcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggcggcgagtggaaaagagcaggcgttgctatcctatcttgctgacacagcggcggtgtggcgaggcgcatggcgagggcgcgcggtggcgccgcgtggtgggtgctggcagcagcgtgggtgctgtgggcggctgcggctgcggcggaggcggaggccaggtcgccgtcggcgaggagggtgcaccggcacctcaagcgcctcaacaagccggccgtcaagagcatcgagagtccagatggagacatcatcgactgcgtgcatatctcccaccagccagcgtttgatcatcctctcctcaagaaccacacaatacagtttaggccggcgtaccaccctgaaagtctatacgatgatacccagagcagcataagctcaaacaatgctggcgagaagccgatgctcccaatgtggaatcgaaatggcaggtgccccgaagggcacggttcccatcgggagaaccaagaaggacaaccggcttcgagctacctccgtgaaggcggtattggcaagaaaccggcacacta

SEQ ID NO: 86793 - protein, 152 aa, Zea mays
  misc_feature: Ceres CLONE 1573425
MARARGGAAWWVLAAAWVLWAAAAAAEAEARSPSARRVHRHLKRLNKPAVKSIESPDGDIIDCVHISHQPAFDHPLLKNHTIQFRPAYHPESLYDDTQSSISSNNAGEKPMLPMWNRNGRCPEGHGSHRENQEGQPASSYLREGGIGKKPAH

SEQ ID NO: 86794 - DNA, 880 bp, Zea mays
  misc_feature: Ceres CLONE 1573428
ccccgcggtggcggccgctcgtcagctgttggtctcccgggctgaaggacttggtttcacctctagtataatggcgtcaacaaattccggctggagaaggcatacctggggctgcaggcgctgaagcgcgccattacggaggatcgcaagaagctgactaagaactggtgctggcctcgacctgtgctgctacttccgcctgttctgcgtggcggcccgtgacgagccttgccagcgcacggtggcctccctgcacctcaaccactgcgacgtcgcccggacgctcccagatcaggtgggtctgacgtccaaactcggcttcttcaaccatcactccaagggcttgtgcggcttgctcccggactccgctttagtccctgctggtcctgtactagattgacgccggaaggaccgcgttgtcctggcctgtcccgtcgcagctcctgtgggtctctaacgtcccgttggtggacgtcaggttcaaaaacttttggggttaggtgcctggggtcaatattctaagagatggctccgggccttttttctacggcatccgagtccgaggataagcctgccctgacagctttcccaaggttggccgggggcaggggaatatggcttgcataagctgtttaattggacacaggacttttcttgccgaggcggggttctggcaaaattggacggccctagatgggaatttagaatgtatggggggtcaaacgggagggaagcctcctgcgttggtttccccacccgcgaaaagtggcaaaagtggaaataggctttgaccctctccctggggaaatacaaaggtgtgcccgagcggtccaaacggggcaccggcttttactagaaagcaaagatggggttacttttt

SEQ ID NO: 86795 - DNA, 855 bp, Zea mays
  misc_feature: Ceres CLONE 1573431
  misc_feature: Encodes the peptide sequence at SEQ ID NO. 86796
  misc_feature (745)..(745): n is a, c, t, g, unknown, or other
  misc_feature (844)..(844): n is a, c, t, g, unknown, or other
agctccccgcggtggcggccgctctagaactagtggatcccccgggctgcaggaattcgtctcacccctagaaaaaagccctcttcctcttcctcgctatacaggacttcccagcagagcagagagctgagacgaaaacgagaagatcccatccactaccgcccggtcgccgtcctcccttcccgccgcgccgctccgcttgctcgccgcagatcgccctcaggattttattccgccctccgtctccgggctcgcttggatcgagatgggcgtctgcgtgtccaaggccgcctcctcctgctgctgctgctgctgctgccgcgagccgcacaacggggttactaacgacaggactgatgctgtaacggatgacgaggaggcatacgccctgcctgcgttccaggagtttaccttcgagcagttgcggctagctacatcagggtttgcggtggagaacatcgtgtctgagcagggtgagaaggctcccaatgtggtatacaaggggaagctccatgcccagcgccgcgtcgccgtcaagcgcttcaaccgctctgcctggcccgacccgcgccagttcctggaagaagctagatcagttggcctgctccgaagcaaaaggttggcaaatttgcttggctgttgctgcgaaggtgatgaaaggttgcttgttgcagaatacatgcccaatgatacgctcgcgaaacatcttttccactgggagtcacaatcaatgaaatggaccatnaggattaagggggtgttctctgtcttgctgaagctttagaaatattgcacaacaggggccgtgctctctacccatgatctcatgcctatagagctctgntttgatgatga

SEQ ID NO: 86796 - protein, 172 aa, Zea mays
  misc_feature: Ceres CLONE 1573431
  misc_feature: SWISSPROT Homolog: EC 2.7.11.1 Non-specific serine/threonine protein kinase
  misc_feature (160)..(160): Xaa is any aa, unknown, or other
MGVCVSKAASSCCCCCCCREPHNGVTNDRTDAVTDDEEAYALPAFQEFTFEQLRLATSGFAVENIVSEQGEKAPNVVYKGKLHAQRRVAVKRFNRSAWPDPRQFLEEARSVGLLRSKRLANLLGCCCEGDERLLVAEYMPNDTLAKHLFHWESQSMKWTXRIKGVFSVLLKL

SEQ ID NO: 86797 - DNA, 908 bp, Zea mays
  misc_feature: Ceres CLONE 1573432
  misc_feature: Encodes the peptide sequence at SEQ ID NO. 86798
ccccgcggtggcggccgctctagaactagtggatcccccgggctgcaggaattcgtctcacccctagaaaaaagccctcttcctcttcctcgctatacaggacttcccagcagagcagagagctgagacgaaaacgagaagatcccatccactaccgcccggtcgccgtcctcccttcccgccgcgccgctccgcttgctcgccgcagatcgccctcaggattttattccgccctccgtctccgggctcgcttggatcgagatgggcgtctgcgtgtccaaggccgcctcctcctgctgctgctgctgctgctgccgcgagccgcacaacggggttactaacgacaggactgatgctgtaacggatgacgaggaggcatacgccctgcctgcgttccaggagtttaccttcctagagttgcggctagctacatcaaggtttgcggtggagaacatcctgtctgaaccgggtgagaaaggctccccatgtgggtatacaaggggaaagctccaatggccagggcccccgtctgccctcaaggcctttcaaccgcctctggccttggcccgaaccgcgggccagtttccctgggaaaaaaaactaaaattcgtgttgggacttggtttcgaaaagcaaaaagggttgggcgaaaaaatttccttaggcatcgttggctcgccccacaggggcactaaaaggggtttgcctttggtttgccccaaataacattgcgccaacatgaaagcgctttcggcaaaaaaatattttttcgccatggggtggggtccccattcgagtgaaaatgggaccaatcgaacacttaaaggggttggttctcttggggcaggggggaaggcttttaaaaaaatattggccccaaccaggggggccgtttgcatattgatatg

SEQ ID NO: 86798 - protein, 154 aa, Zea mays
  misc_feature: Ceres CLONE 1573432
MGVCVSKAASSCCCCCCCREPHNGVTNDRTDAVTDDEEAYALPAFQEFTFLELRLATSRFAVENILSEPGEKGSPCGYTRGKLQWPGPPSALKAFQPPLALARTAGQFPWEKKLKFVLGLGFEKQKGLGEKISLGIVGSPHRGTKRGLPLVCPK

SEQ ID NO: 86799 - DNA, 960 bp, Zea mays
  misc_feature: Ceres CLONE 1573437
  misc_feature (960)..(960): n is a, c, t, g, unknown, or other
ctggagctccccgcggtggcggccgctctagaactagtggatcccccgggctgcaggaattcgtctcacccctagaaaaaccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgttaggtcgaggtttcttcggcgacggtgcagccgctggatgttagtctggcagatcggggccgagctaggcagtgttgggttgtaacatttgtatcgcatgaatgaactcagagcatctcaatgttaaaactgttaaggggcagacctggtgccagaggctcccacatgagtgggttctagggaagggataatccgaagcaagcctttcccccctgcaaatgcagagatgcggcttttgaccccttgaccctgggtgactcagtggagacaccctctcaccactgcaaacagggcctgtcctttcctcatcgtttaaaaccgagccaaattaaatttcttctttccttaagcaaaaagggggaacctaatttgcctgccattgcctgccaaagggaaaaaggaaaacagacccggggcaatacactccccataaaaaaaaaatttccgggcttattaggggaattggggaggggccctcccccctttctgggaaccattttcgtagggggaaaaatttcccccccttttagaaaaaaacattaaggggaaatttcccctcttgtggttcccaaaattaagggggtgggaaagattttttccttttataaaaaaagggggtcccttgtgtccccccaaaggaggggtttctctaaggggaaaataccccggaaaaaagcccctccccatggtgtccttcggggaaaaagggggccacattttgtaaaaaaan

SEQ ID NO: 86800 - DNA, 1186 bp, Zea mays
  misc_feature: Ceres CLONE 1573438
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
gtgaggggtggnaatgnnnagccagtaagcggccacctgtcaccgcgcggaggcccacctcgttttttttccaagctggagctccccgcggtggcggccgctctataactagtggatcccccgggctgcaggtaattcgtctcacccctagaaaaaccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgttaggtcgaggtttcttcggggacggtgcagccgctggatgttagtctggcagatcggggccaagctaggcagtgttgggtgtgtaacatttgtatcgcatgaatgaactcagagcatctcaatgttaaaactgttaaggggcagacctggtgccagaggctcccacatgagtgggttctaacggaagggataatctcgaagcaagcccttccccctgcaaatgccagagatgcggcttttgaaacccgtgaacctgggtgaacccaggggagacaccctcctcagcccctggaaaccagggcctgttcccttccctccatccattaaaaaacctgaagccctatttaaatctcgttcgcttccctaaagcgcaaacatgggggcgagggtaaaatttagccttgccattctgccctgcgcaaaggggaaaaacaggaacactccaggccgcgttgtgtccaataacactatccttgtaaaagagaaagaaataatagtctgggacaatgtggtacggagggaaaatttgatgagagagggggagctttcggcgcctaatgtccaatgggggaaaaccaaatggttgcgcactggggggggaacacaatatctggccccccatccatatttatcccagcgatacgacaccatcttataaggggaaacgcaattctacccgcagagcccgatgtggattacctagccaacccaatagttaataacatcctaggggacaagagggagagttctacgcagtcccattgatagtgatagataagcgcccgcggagagtccagcggggtgtgctccctccaaaactatgaaagagagggtatgacctccagaggcactgggcaaaatatgagacccctctcgtcaa

SEQ ID NO: 86801 - DNA, 834 bp, Zea mays
  misc_feature: Ceres CLONE 1573446
  misc_feature: Encodes the peptide sequence at SEQ ID NO. 86802
tccccgcggtggcggccgctctagaactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacctccatctccctcgaggagaacgggactgtcgtgctcacgccgcatcagggccaagaagcctcctccaactttgctgcccatcacttcgatggactcgccaagggctttgacaccaggtgcaacgatattttgtgggcaaatacttgtttcactgggtagcggagactactttcggttttgtttggagggtttctgaagttaaaggaaaatgatgtgggtttggaat

SEQ ID NO: 86802 - protein, 158 aa, Zea mays
  misc_feature: Ceres CLONE 1573446
  misc_feature (30)..(156): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETSISLEENGTVVLTPHQGQEASSNFAAHHFDGLAKGFDTRCNDILWANTCFTG

SEQ ID NO: 86803 - DNA, 838 bp, Zea mays
  misc_feature: Ceres CLONE 1573448
  misc_feature (681)..(681): n is a, c, t, g, unknown, or other
ggagctccccgcggtggcggccgctctagaactagtggatcccccgggctgcaggaattcgtctcacccctagaaaaagtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagttgcagtaactgcgtgaaatgctataccggagatgccattgtgcacggaggtggtttattttgaggaagagtcgggacacagtttggtgaattttgttgtgtgctggtctgagagctagtgctgctgggattgaggaaatgcaagttaataatgaggcaccactagggtgcctcaagccaaatatttctcagtataactctccagagcagataggtggtgttgaagggtttcctgagaataatgaaaaaaggaatgatattgttgctgcagaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaatagggaccacggtttccctattgagaacagggnttcatatcttccattccagatgctccctcaaggtcacccccatgatgcacagcttcaggaaattcagtatttttgtggttattgactttggagcaacctgtgaacaagtggaacaatcccattttcacagaaattcatcgagttttcattctgtcct

SEQ ID NO: 86804 - DNA, 884 bp, Zea mays
  misc_feature: Ceres CLONE 1573449
gctctagaactagtggatcccccgggctgcaggaattcgtctcacccctagaaaaagctatggttcggagcacgacgagccatagcttctacaagcactgggcgggtctcgtggcggtgcgcgggcgcttggtggacgacgctcaatcggaggcggacagcgcttgggagtcaggcgtgcgaccttgcggctgtgctcaggcggggcgttgcgtgaactgctagggagtctggtgtgcaaagggcggcgctcgttcctcaggcatgtgcggacgacgctcagacacatggctgtgtcgaccacttgcagacgacgccgacacagatccaggtccaggtccaggttaagtattgttttttggttgtgtggacgtgattgctgctcccgagatatgttctgtagcggcaacgtccaccctctatgtctgctggtttaactttttcaatatacccatcggatttggatgatgcatgactgccgataatcttcatgtgcttggatagatccaaagagttgggcactatgattggcccatttctactctcttaaaaatattatggcaggaccattgcttgatttccctgattttggaataatacagccctcccaattaacccttgtcctatttcgacgatcaattgtttcagggaaaataattgtggtcacttcagtttgaacgcaaattacaaaaaaaggggggcccaattcttaaacccttcttgcgaattctcccccttttgaggctccctcaccctcttaacccttttgggttcttggggaaattttgcggttttttttcgacgggccttgtgacacctctttttctcttataaatcagcgcaacaaggggggaaataaaaatggtttttgcccgcacttaaaag

SEQ ID NO: 86805 - DNA, 823 bp, Zea mays
  misc_feature: Ceres CLONE 1573450
  misc_feature: Translation starting site: 355
ccccgcggtggcggccgctctagaactagtggatcccccgggctgcaggaattcgtctcacccctagaaaaaaagcccacccagagctctgtagaagagaggggaggaaggaccgaggaccaaccggagccccactcggccgccgcctctcacctccaccgactgcctgcgtcccaccgctcctgctgccgcccgttgctctcgccattgaagccctcgccgcctccgcccgcttgcccgccctcccgtcggctgccttccggatgagaagcggcgcaacctgggcggtggaagcgtggtcggcctgagccttcgtgggggttagcgccgagaaggatcctggagattaagcgcatgggttccttggaggcccggtacaggccggccggggcagctgaggacacagctaagcgaaggacccagaaaagcaaaagtttcaaagaggttgagaaattcgatgtttttgtgctggagaaaagttctggttgcaaattccggtcgttgcaacttttgctcttcgctatcatgtctgctgcgtttctaacactcctatacacaccatctgtgtatgaacatcagttgcagtcaagctctcggcttgtcaacgggtggatatgggataaagaggagttctgatccccgatatatatcttctgccagcattcaatgggaagatgtatataaaagcatgcaaaatgtgaatgttggtgaacaaaaactcagggttggactcctgaattttaacaggactgagttcagtgcttggacacatatgctccaagaaaatgatttttcagttctaaggctagagccatgccaatgt

SEQ ID NO: 86806 - DNA, 904 bp, Zea mays
  misc_feature: Ceres CLONE 1573454
  misc_feature: Encodes the peptide sequence at SEQ ID NO. 86807
ccccgcggtggcggccgctctagaactagtggatcccccgggctgcaggaattcgtctcacccctagaaaaaacggctgtggctgatccattctaacagagatgacctgctggagccagacacctgatacccacactatatagatggcataggctatcgcctggtggttgtttctctgtctcaagtcgatcccgtcccttcgcttcaccatgatgcaccacgggagttaatgcccgggtgcgtctgctgggtgagtagcattgatactgggcgctccgcgtgtacaaggctgcctcatcctgctggtgttgttgctgctgcgctcagccgcacaacgggtgtcacataaccaccggacttgatgatgttacggatgacgaagagggatatgccctgactgatttacaccaattcaccttgcaccacgggcggctagcctacatcaaggtttgcagcggagaacatcttgtctcgacagggtcagaacgctccacaatgtggtatacaaggtggaagctcatacacagcggccgggagccgtcaaacgcttcaaccggttctgcttggacgaacccgcgccaatttcctggaagaacctagatcacttggcccgctcctaaaacaaaaggtgggcaaaatttgcttgggctgttgcacccgcaggagaagaaaaaggttcctttgtttgcataacaacaaggccccaattgatacagcctcggcaaaactttcgtgtttccaacggggggaattcccaaaatcactgggaaaaaggggacgcgtgggaattctagagaggggtgggttccctcccggaaaaatagctttaaaaggggttttataaaaaaaattgtgggcccccaaaaaatgggggagtcctcgggggggttattgtcttaaaaac

SEQ ID NO: 86807 - protein, 34 aa, Zea mays
  misc_feature: Ceres CLONE 1573454
MWYTRWKLIHSGREPSNASTGSAWTNPRQFPGRT

SEQ ID NO: 86808 - DNA, 828 bp, Zea mays
  misc_feature: Ceres CLONE 1573456
  misc_feature: Encodes the peptide sequence at SEQ ID NO. 86809
ggagctccccgcggtggcggccgctctagaactagtggatcccccgggctgcaggaattcgtctcacccctagaaaaactccctctcgcgcgacgtctcaagcgcgaaccccacgaagccggagccaagccacgacgggtcgacaggtcgacggtgcctcgacctgaccacctcgcttcctccgacgcctagggttttctaccggacgccgccgccgccgcagcagcggcccgggatgcaggtgagcccgcgcagttagacggcgacggacccaccgccgccgcgcgccatgtcattcttgcggcggcgaaaaccgctgccgccctctgaccgtgacgagtccgaccacgacgacgacgacacggggaagaagccgtcctcatcctccgggtcgccgaccgaggagcccacgaagcggaccatggccaagtggtcgtgcgtggacagctgctgctggatggtcgggtgcatgtgctccgcctggtggctactgctctttcgatacaacgcgatgccggcctcgttcccgcagtatgtcaccgaggccatcacggggccgctcccggacccgctcggcgtgcagctgcagaaggcagggctgctagttaagcacgccggcgtcttcgacccggacatcgtcaccgggggcctggaggtatgggaggggcaccactgcgacaaggggctctttcgccagcggctatggggcggaacgtttggtcacgttgaacacaaacttctatgctggtttgaaccttgtcatttggaaaatggaactggattacacaaacctggaaaaaggggcagggccggttcacaggcctggtt

SEQ ID NO: 86809 - protein, 179 aa, Zea mays
  misc_feature: Ceres CLONE 1573456
  misc_feature: SWISSPROT Homolog: EC 2.3.1.158 Phospholipid:diacylglycerol acyltransferase
MSFLRRRKPLPPSDRDESDHDDDDTGKKPSSSSGSPTEEPTKRTMAKWSCVDSCCWMVGCMCSAWWLLLFRYNAMPASFPQYVTEAITGPLPDPLGVQLQKAGLLVKHAGVFDPDIVTGGLEVWEGHHCDKGLFRQRLWGGTFGHVEHKLLCWFEPCHLENGTGLHKPGKRGRAGSQAW

SEQ ID NO: 86810 - DNA, 796 bp, Zea mays
  misc_feature: Ceres CLONE 1573457
  misc_feature: Encodes the peptide sequence at SEQ ID NO. 86811
ctccccgcggtggcggccgctctagaactagtggatcccccgggctgcaggaattcgtctcacccctagaaaaacagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagagtggtgctgtgcccatctttgtcaagctactcaactccctcagcgaggatgttcgtgaacaggctgtatgggctttaggtaatgttgctggtgactccccaaagtgccgtgatctggtacttggtcatggtgggctataccctttgctgcagcagcttaatgagcatgctaagctttcgatgcttaggaatgccacatggactctctccaacttctgtcgggggaagccacaaccaaactttgatcaggtcaaaccagcattgccagcactacagcaccttattcactctcaggatgaagaggtcctaactgatgcctgttgggcgctctcatacttgtctgatgggactaatgataaaatccaaagctgtattgaaatctg

SEQ ID NO: 86811 - protein, 264 aa, Zea mays
  misc_feature: Ceres CLONE 1573457
  misc_feature (85)..(126): Pfam Name: Arm Pfam Description: Armadillo/beta-catenin-like repeat
  misc_feature (128)..(168): Pfam Name: Arm Pfam Description: Armadillo/beta-catenin-like repeat
  misc_feature (170)..(211): Pfam Name: Arm Pfam Description: Armadillo/beta-catenin-like repeat
  misc_feature (213)..(252): Pfam Name: Arm Pfam Description: Armadillo/beta-catenin-like repeat
PRGGGRSRTSGSPGLQEFVSPLEKQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNIASGTSENTKVVVESGAVPIFVKLLNSLSEDVREQAVWALGNVAGDSPKCRDLVLGHGGLYPLLQQLNEHAKLSMLRNATWTLSNFCRGKPQPNFDQVKPALPALQHLIHSQDEEVLTDACWALSYLSDGTNDKIQSCIEI

SEQ ID NO: 86812 - DNA, 829 bp, Zea mays
  misc_feature: Ceres CLONE 1573458
  misc_feature: Translation starting site: 231
tggagctccccgcggtggcggccgctctagaactagtggatcccccgggctgcaggaattcgtctcacccctagaaaaactctccctccacaacggcgtagctgcagcagccaagtcctgtccgctctcttcgccgccaccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaaagcagtccaagatcgcttctaagctatcgcccatatctgatgaaaatacagtgcttgaattggttatcattggttgtggtccagctggttctttctctagcttcagagtcggctaagaaagggctcactgtaggtctcattgggcctgaccatccattcacaaataactatggttgtgtgggatgatgaaattaaaagatctcgggctaaagagctgtattcgagcatgtctggaaaggatcctttgggctacctaagacaaaaccagcccaatactgattggccggtccttatggcaggggggcat

SEQ ID NO: 86813 - DNA, 1108 bp, Zea mays
  misc_feature: Ceres CLONE 1573463
  misc_feature: Translation starting site: 230
  misc_feature: Pfam Name: S-antigen Pfam Description: S-antigen protein
  misc_feature (11)..(11): n is a, c, t, g, unknown, or other
  misc_feature (12)..(12): n is a, c, t, g, unknown, or other
  misc_feature (70)..(70): n is a, c, t, g, unknown, or other
aaaaaagcatnnaggggagaactcagacaagggggggcgaccccggccaaggggaaaagggggggggggnccaaactggggctccccgcggggcgtgccgctttcaacaggggagcccccgggctgcattccctcggcggacccctagaaaaagccatacacgctccaggctctcgtttcctggtaggcgctggtacaagcggaagcagcagtagcgcgaggcatccccatgccgggggcaatctcttcctcggcgtcggctttacacctccccgtcgcggcctccgcgccgcggcgcaggcggggcagtgtgggtgctgctctgcgctcgtacggctacagcggcgcggagctgcggctgcattgggcgcggcggggcccgcctcaggatggagcggcgtcggtacgcgccgcagcggcaccggccgggggcgaaagcgaggaggcagcgaagagcaaccccgcgggcggggcgggcgcccctcagggaaagcacggccaaagcggggggaagcaggccgcaagcacccaagaccgttggaacagatggccccggaagcgaaacccagaagcgcttgcaaagggcggaaaacgagaacgaaaaaggggggacagggagaccgcccagcaacaggacggacggcggggcaagggcgcgggaccacaaagagcccggaatcagtcacgagcgcgggactccctggggggacgagcgaagtaagaagacaaaagccggaaatgggccacggggagcggggggggcaaaggctccacagaaacgctcccgccaagggcagagagacgcaatggcacagagccgagacgagaacgacgcaaaagggcccaagaaggcccagacagacgggagaagaacgcaggaggcggaacgaaacaacaggggccagcgagaaccgcaaaccaccgggagcgaaacacaagaatggccgggacaacgacaggaagaagggcgcccgcatatgagtgggcagaaggcgcgggagaaaggaaggagcaacccacgagaccgcgcagcgcatatgaagagcgaccccggcaatcacggggagacggaaacagaggccagcgggaaacacgcgggcaaccccat

SEQ ID NO: 86814 - DNA, 788 bp, Zea mays
  misc_feature: Ceres CLONE 1573469
  misc_feature: Encodes the peptide sequence at SEQ ID NO. 86815
ctccccgcggtggcggccgctctagaactagtggatcccccgggctgcaggaattcgtctcacccctagaaaaaatgtaaggtccgcagaagtatgtttttcaggatggcgccagagtgtcctgcgttccatttcatcttcctccgtctccgatgctggcgtttgatgttacttgatacgatctctcgggccttcttctttagcggcaacgacggggtgatcactgattcagcttgctgctgcgcctggtcgtggtcaagtagtgggtggcttcactcgtaattatgatggaggtggtctcttgcagcctcttctgctcggagattacatcagataaaaacaagcatatggacgattcggggcaatgctcttgggcttggtcttgaggatgcgcggggattacacggaccagaagatacacatctgcctgtgcactaaccacgagtgtgaacttccaatcccggtgagtgtggggcaaggcccataaagactcagggattccatgtaagcgacaaggatgccgtcctgatcgggattatttccatgaagagccgggcactccgacatggtcatgattcaagggcttccggatcggcctgacggctcctcgatccgtactggtttcacggagtagaaccgcaagctgactgtgtactgcgagaagctgagctaaataacatcaggacgctgcggtgctcttcctgcatgagttcggaatcgggaggttacatttctagaagcagctgagcgatcttggtcgctacttcgagagtggagatggatgttcc

SEQ ID NO: 86815 - protein, 58 aa, Zea mays
  misc_feature: Ceres CLONE 1573469
MAPECPAFHFIFLRLRCWRLMLLDTISRAFFFSGNDGVITDSACCCAWSWSSSGWLHS

SEQ ID NO: 86816 - DNA, 818 bp, Zea mays
  misc_feature: Ceres CLONE 1573471
  misc_feature: Encodes the peptide sequence at SEQ ID NO. 86817
acccgcggtggcggccgctctagaactagtggatcccccgggctgcaggaattcgtctcacccctagaaaaagaaggaggagcctgcccgcgcctgcgcctggttgtaattgtagctcacgctcacccttcagttgaccaccgatgcggaagaaatggcggccagtcgccgggagcaccgccgcggcttcccgctggtcccgctgcagctgtcgctcctggcggccgcctcgtactgccgactcatctccaacggcggcccgcccgcgcagcaccacccggtcatccgactcacggcgccgccggcctaggccaagagtgagcagacatacggcttcctccccagcaccaccacagtgctcggcaacctcttactagcgctagcctacggcttcttcatgttcaaggcggccacgttcatgtcggcgggcagtgagctgctgctagagatcatggggcccggcctcatcggcggcgtccacactcccatcataagcgccatacgcgacgcactcctacgcctagtgtccggcctctccgggagcaaacaggaggcacacagccaagtgctgatcgggacggcgctgctcgccggttccacagacttccacctcaccctgcgcgagcgaaactgtgttgcccttggcaaatgtgacctcagaacacgccgtgaggtagttagacgtgacagacccctagggtcttcaacgtgactggcactgggggtaacgaacgtatgtgcagaccaacctagtccgccagggatcagggggggctatctgttaagcccccgaaatcattccgaaaagttaccgcaac

SEQ ID NO: 86817 - protein, 104 aa, Zea mays
  misc_feature: Ceres CLONE 1573471
  misc_feature: SWISSPROT Homolog: EC 6.3.2.9 UDP-N-acetylmuramoyl-L-alanine--D-glutamate ligase
MFKAATFMSAGSELLLEIMGPGLIGGVHTPIISAIRDALLRLVSGLSGSKQEAHSQVLIGTALLAGSTDFHLTLRERNCVALGKCDLRTRREVVRRDRPLGSST

SEQ ID NO: 86818 - DNA, 804 bp, Zea mays
  misc_feature: Ceres CLONE 1573472
ccccgcggtggcggccgctctagaactagtggatcccccgggctgcaggaattcgtctcacccctagaaaaagtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagttgcagtaactgcgtgaaatgctataccggagatgccattgtgcacggaggtggtttattttgaggaagagtcgggacacagtttggtgaattttgttgtgtgctggtctgagagctagtgctgctgggattgaggaaatgcaagttaataatgaggcaccactagggtgcctcaagccaaatatttctcagtataactctccagagcagataggtggtgttgaagggtttcctgagaataatgaaaaaaggaatgatattgttgctgcagaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaatagggaccacggtttcccctattgaagaacagggtttgaataatcttcccattcaaaaatgctcccctcaagggccaccccccatgaatggcgccagctttcagggaaatcttcaggaattcttggtggggttatttggactttttggaaaacaaacccctt

SEQ ID NO: 86819 - DNA, 819 bp, Zea mays
  misc_feature: Ceres CLONE 1573473
  misc_feature (377)..(377): n is a, c, t, g, unknown, or other
tccccgcggtggcggccgctctagaactagtggatcccccgggctgcaggaattcgtctcacccctagaaaaatcatcgcgtggtggccgcgccgctctgttcatccgtcccctcctccttccggctctcgctgtcacatgtcgtgtggtgtgggggcgctctgatccggatggtgcagcgccgcgggatcgcccacggccatgattgatcgcgaacgagcagttgcaataactgcgtgaaatgctataccggagatgccattgtgcacggaggtggtttattttgaggaagactcgggacacactttggtgaattttgttgtgtgctggtctgagagctagtgctgctgggattgaggaaatgcaagttaataacnaagcaccactagggtgcctcaagccaaatatttctcagtataactctccagagcacataggtggtgttgaagggtttcctgagaataatgaaaaaaggaatgatattgttgctgcacaaaaaatctgggaggcgactccaaaccaaggccttagcaggcccatctaccgacaagaattttatgcctggccatatatttattcagattatcaaatcatgcgtcagccactaccttatggttttgacaaccaattttatcatataaatagggaccacggattccctactgagaacagggctcaatatcttccattcaagatgctccgctcaaggtcacccccatgatgcacagcttcaggaatttcagtatttttgtggttattgactttgaaacaacctgtgacaaggtgaacaatccattttccacatgaaatcatcgaggt

SEQ ID NO: 86820 - DNA, 964 bp, Zea mays
  misc_feature: Ceres CLONE 1573478
  misc_feature: Encodes the peptide sequence at SEQ ID NO. 86821
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
agggaagagagatttttgttgggctggcaccccctacccttcccccatgcgcgaccctctctcgttgccaaaacaaccnnnncacaagctggagctccccgcggtggcggccgctctagactagtggatcccccgggctgcaggaattcgtctcacccctagaaaaacccgcccgtcggcgttgtttcgtctccaccgccgctctcctttccagtctccatcaccgctcgtctccccgtaccgcccgcgacccccctcccctgcgagatccggggcgcgatgtggcgcaactgcgtctcgcggggcctctccagggccaaggcctccgcctccaggctcctctccacggcgtcgtcgtcctacacggtggtcgaccacacctaccacgcagtggtggtgggggccggcggcgcggggctccgggcggtgatcggcctctccgagcacggcttcaacaccgcgtgcatcaccaagctcttccccacgcgctcgcacaccgtcgcggctcagggaggcataaatgctgcacttggaaacatgagtgaagatgactggaggcggcatatgtatgacacctgttaaggggaagcgattgggctggggccaccaggatttctatttcagtagatgtggcagaagaggccacccaaaaccctgtttataagaggcttggaagaaactatggcacctccccttttttcaagaaacctgcaagtaggggaaaaagaatattacccaaaccttggccttttgggaaggtggaacaagcttcggaatttttgggcaaaagggtgggaacaaggccctaacccgtttgtggccctggcgccctgggctgacttgatacaggggaaactgctttttggctgtgcaaacccccaataatggggttccaacccgatgtgcaagcccccaaccgcttccaattttttttggtggggaaataactctttggtcttttggt

SEQ ID NO: 86821 - protein, 100 aa, Zea mays
  misc_feature: Ceres CLONE 1573478
  misc_feature: SWISSPROT Homolog: EC 1.3.5.1 Succinate dehydrogenase (ubiquinone)
MWRNCVSRGLSRAKASASRLLSTASSSYTVVDHTYHAVVVGAGGAGLRAVIGLSEHGFNTACITKLFPTRSHTVAAQGGINAALGNMSEDDWRRHMYDTC

SEQ ID NO: 86822 - DNA, 812 bp, Zea mays
  misc_feature: Ceres CLONE 1573479
  misc_feature: Encodes the peptide sequence at SEQ ID NO. 86823
  misc_feature (605)..(605): n is a, c, t, g, unknown, or other
  misc_feature (611)..(611): n is a, c, t, g, unknown, or other
ccgcggtggcggccgctctagaactagtggatcccccgggctgcaggaattcgtctcacccctagaaaaaagctgcgctgctcgcccctcgcgtttctttgctcaattgggggtcacggtcacggcccgcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctccgcagcagcagtacggaggcactccgctcagctcgccccccaagctcaacctgttccaccaaactcgcccccagttccaccacttcccgccgccgcaggtcggcggcctgccaatcctggagaacctgatgccgatgggccatctagaccagttccctcgcgacccangcttcnccgagcgcgcggcgcggctgtccggcttcgacggccgccccggtggaagtggctatggaggcgtcggcgtcccgggacattttgcatcccggacgcggccccttggggcaattaaggaactggacctcggaaaaggccggaccaattctcggggtccaattcgggttcggcaagcgggaaatgggcccaaaagggggcctc

SEQ ID NO: 86823 - protein, 188 aa, Zea mays
  misc_feature: Ceres CLONE 1573479
  misc_feature (120)..(120): Xaa is any aa, unknown, or other
  misc_feature (122)..(122): Xaa is any aa, unknown, or other
MNCGPPDQLPPGSAPSCFLNLNWDQSMAADQLDPALSSMVSSPASNSTAAAAVTDGRALHGISPQQQYGGTPLSSPPKLNLFHQTRPQFHHFPPPQVGGLPILENLMPMGHLDQFPRDPXFXERAARLSGFDGRPGGSGYGGVGVPGHFASRTRPLGAIKELDLGKGRTNSRGPIRVRQAGNGPKRGP

SEQ ID NO: 86824 - DNA, 1015 bp, Zea mays
  misc_feature: Ceres CLONE 1573480
  misc_feature: Encodes the peptide sequence at SEQ ID NO. 86825
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (109)..(109): n is a, c, t, g, unknown, or other
nttttgagggggnnttttttgaatattctctgagcacttagcaatcattatcaaatgagcaaactgaattgccnnnnnnnnntnnnnnnnnaaaagctgggactccccncggtggcggccgctctacattactggatcctacgggctgcaggtatacgtctcagtggtacaaaaattcccagacaacggctgcatctcctgcatgtgccacaactccgacatgctgtacagcgccaggcagaccgccgtcgtgcgcgcctccgacgacttctacccgcgcgacccggcatcgcacaccgtccacgtcgcctccgtcgcgtacaacaccgtcttcctcggcgagttcatgcagcccgattgcgacatgttccatagcttgcatccggcggcggagtaccacggcgcggcgagggccatcggtggctgcccgatatacgtcaccgacaagccgggggaaccacaactccgaagctgctcatgaaggttcgtgctccccgaagggctcccgggctaagggacgaaactttcccggggccggccccaaaaaactaatttgccttttttcccccaaccccggggggccccaaaaggggacacaaattttttccccccaaaaaattttggaaaacccttaaaaaaaaaaattctccggggcgcccctggtggtgggcgcttttttttccaaccactcccccccacgaggaaaacccccggggggggggtgtccccccccccgtgtaacacaaaaaaaagaaaaaaacctttttttgttaaataaaaaaacacattttttccccggagggggacaccttttatacaacgagaaacaccaggtggtgttgttgcccaaaaaaaaaaatttaggaaacgcccatttttgtgcgccgttttccctaaaaataaaacaaaccccgcgggtgggtgggggagaatcccttataaaccccccgttgtgtttttctcccccccccccaacccccgggggaattacatagagggacattcccccccgggg

SEQ ID NO: 86825 - protein, 92 aa, Zea mays
  misc_feature: Ceres CLONE 1573480
  misc_feature: SWISSPROT Homolog: EC 2.4.1.67 Galactinol--raffinose galactosyltransferase
MCHNSDMLYSARQTAVVRASDDFYPRDPASHTVHVASVAYNTVFLGEFMQPDCDMFHSLHPAAEYHGAARAIGGCPIYVTDKPGEPQLRSCS

SEQ ID NO: 86826 - DNA, 1262 bp, Zea mays
  misc_feature: Ceres CLONE 1573484
  misc_feature: Encodes the peptide sequence at SEQ ID NO. 86827
  misc_feature (927)..(927): n is a, c, t, g, unknown, or other
  misc_feature (977)..(977): n is a, c, t, g, unknown, or other
aaaaaaagaaaaaaaaaaacgggcgcgccccactcatcacatacagcagaagaccccctgccctacccaacacccgataaaaaaaacgggagctcaccgcggtggcggccgctctaaactagtggatcccccgggctgcaggaattcgtctcacccctagaaaaaacacacgaacaccgcaccgcaacgtatccggctaggggaagagctctttccatcagctgtgccgtgcacaacgcacggcacgctggatttggttcgcatcgcccccgccaagaaagacgctgccctgatcgggctgagcgggcaggaagcagcagcaggcgggccacatgccgagcggcagctcattctaccggtcggtgaacctcaagcacgtcaagctggggtaccattaccaggtgaaccacttcctagagctgctgctggtgccggtgatggccgccacggagcttggagctgggggcgcaccacagcccccagacgagctagctcctcccatggggagcgctcagaggagaagcttggaacctgggaccgacgatcccctccttgcttcccggcgaaccccgtgggcccgatccttgtcaaaacggggcacacccattgaacaccgtagcaaatgagatcagggagatgcccccaaaggaacccgcgtacgggacaaacccagtggatgtggggaaacgtaaaaggaccacgcgtgggccgcgaataaaaaaaaagagatccaagcgcccacgagaatcacaaatcccccgttgaggactcacaaaccaaggtataagtcgcgccctcactcgataatgttttgggggtccctaaaaaaagcagtattaggacaagagttgaggaggaaaaaaataaacaacacaccaacccgtgaagaaggactcacccaaagcacgttagatgagagaggacggntgagcagcgacgtaagaacgttaagaatatgttaaagtaggagcgagggncaggggtacgcggggccctttgatatgagacaaaagtcaaccactccacgcggataagatcccccatggagtgcgaaaaaatctacacatacagacgggtggggcgcgccacaagcgggactatgagacgaaaaaacacccaagaggtggcgcccccgtggcccttacagagtaaacttgtgcctccaaaccacccactgataagtacaattttctttcgagagccccagcaagaaaccggaattaagtgattagtggtagaggtgattatctttgtccttcagg

SEQ ID NO: 86827 - protein, 97 aa, Zea mays
  misc_feature: Ceres CLONE 1573484
MPSGSSFYRSVNLKHVKLGYHYQVNHFLELLLVPVMAATELGAGGAPQPPDELAPPMGSAQRRSLEPGTDDPLLASRRTPWARSLSKRGTPIEHRSK

SEQ ID NO: 86828 - DNA, 861 bp, Zea mays
  misc_feature: Ceres CLONE 1573485
  misc_feature: Encodes the peptide sequence at SEQ ID NO. 86829
ggagctccccgcggtggcggccgctctagaactagtggatcccccgggctgcaggaattcgtctcacccctagaaaaacagcctcttgttgtcacttattagctctctctcagctaacctccctaggaataataagctgcaaaaggcacaaaggcgacgccgataccgaagcaaataccatagcgttgatgtaaagtggcgccagaggagagagagagaaaaaaaaaggaagcgagcgagccgagaaacatggacgaggaagaggtccatatcgcagttgggaagaactcaaggaaggagaaaaccaacatactgtgggccgccgccaatttccccagggccaccatcgttcttgtccatgttcactggccctccaagtggatgcctttcatgggtggcaaagtgctatacaagttcgctgatgagaaggagaaggagatgcatagaggcagagaaatgaaagtaatggtcaatatgttatcacagtacaaaaaaatgtgcgggacgagaaaggttagtgcacattaccttacacatgatgacactgttgccggtgttgtgaacctcataaagaagctcaaaattaaaagaatcgtcatcggttcaaggaacatgtcaaggcaagttgtggttcgccagtgctgtcaggtttggctggtactcaacggcaaacacatctccaccagcaatgatcaccttggaatatagtgaaaatataggatatggggagggggggagcctcagggaatttttggccttctaatacactgaagctagggtggaagggataccttgaccgggcttcccctggaaacccccccaaaagtggattcctttggtaaagaacaaaacacaccatgc

SEQ ID NO: 86829 - protein, 152 aa, Zea mays
  misc_feature: Ceres CLONE 1573485
MDEEEVHIAVGKNSRKEKTNILWAAANFPRATIVLVHVHWPSKWMPFMGGKVLYKFADEKEKEMHRGREMKVMVNMLSQYKKMCGTRKVSAHYLTHDDTVAGVVNLIKKLKIKRIVIGSRNMSRQVVVRQCCQVWLVLNGKHISTSNDHLGI

SEQ ID NO: 86830 - DNA, 777 bp, Zea mays
  misc_feature: Ceres CLONE 1573492
  misc_feature: Encodes the peptide sequence at SEQ ID NO. 86831
cgcggtggcggccgctctagaactagtggatcccccgggctgcaggaattcgtctcacccctagaaaaatagaaaaaaggcagcattgagctgcaactgcaacagcttggaagcagtaagcacgcatcgccgccccccatctcccccgcaccgcgcacctctatggccgccggcgaaggcggaggtggggacatcggcgccgactcggagcggcgcctgcaaaaggctatggataagctctaccacttccccaagcccaagtcgagtatcaccggtggctccaagccctcttcgacgacctcggctccaagctccgggagagcggtggggaacgcagcggcggacgcagcgaggacgttcggggtggtgcgcgggtcgcgactcccgcatcagatgttggccatggcagcgatctcgccgccaccgccgtgccgcccctgggaccgcgccgacctcatgcgacgtctcgggtcattcacagccatgacctggttcgccaagcccaaggttattattcccgttaactgtgcaagacgaggatggactagcattgagccggatgttataacatgtgaagcttgtggggcacgactcctgttctccagtccttcctcatggacaacacaacaagttaaaaaagctgctgctgttttcagcctaaatctggactctggacatagactactttgcccgtggattgataacacatgtgatcgatcacttgggttatttccaccaacacctcctcctgttttagatgggcactacaatgagctt

SEQ ID NO: 86831 - protein, 205 aa, Zea mays
  misc_feature: Ceres CLONE 1573492
  misc_feature (92)..(203): Pfam Name: zf-C3HC Pfam Description: C3HC zinc finger-like
MAAGEGGGGDIGADSERRLQKAMDKLYHFPKPKSSITGGSKPSSTTSAPSSGRAVGNAAADAARTFGVVRGSRLPHQMLAMAAISPPPPCRPWDRADLMRRLGSFTAMTWFAKPKVIIPVNCARRGWTSIEPDVITCEACGARLLFSSPSSWTTQQVKKAAAVFSLNLDSGHRLLCPWIDNTCDRSLGLFPPTPPPVLDGHYNEL

SEQ ID NO: 86832 - DNA, 787 bp, Zea mays
  misc_feature: Ceres CLONE 1573493
  misc_feature: Encodes the peptide sequence at SEQ ID NO. 86833
ggagctccccgcggtggcggccgctctagaactagtggatcccccgggctgcaggaattcgtctcacccctagaaaaatagaaaaaagggagcattgagctgcaactgcaacagcttggaagcagtaagcacgcatcgccgccccccatctcccccgcaccgcgcacctctatggccgccggcgaaggcggaggtggggacatcggcgccgactcggagcggcgcctgcaaaaggctatggataagctctaccacttccccaagcccaagtcgagtagcaccggtggctccaagccctcttcgacaacctcggctccaagctccgcgagagcggaggggaaggcacccgcggacgcagcgaggacgttcggggtggtgcgcgggtcgcgactcccgcatcatatgttggccatggcagcgatctcgccgccaccgccgtgccgcccctgggaccgcgccgacctcatgcgtcgtctcgcgtcattcaaagccatgacctggttcgccaagcccaaggttattagtcccgttgactgtgcaagaagaggatggactaacagtgagccggatgttataacatgtcgagcttgtggggcacgactcctgttctccactccttcttcatggacaacacgacaagttaaaaaagctgctgctgtttgcagcctgaatcctgactctggacatagactacgttgccccgtggattgataacctgtgtgatgaatcacttgactttattgtcaccaacaactacctcctgtttaaatggggaactactatgaga

SEQ ID NO: 86833 - protein, 179 aa, Zea mays
  misc_feature: Ceres CLONE 1573493
  misc_feature (92)..(180): Pfam Name: zf-C3HC Pfam Description: C3HC zinc finger-like
MAAGEGGGGDIGADSERRLQKAMDKLYHFPKPKSSSTGGSKPSSTTSAPSSARAEGKAPADAARTFGVVRGSRLPHHMLAMAAISPPPPCRPWDRADLMRRLASFKAMTWFAKPKVISPVDCARRGWTNSEPDVITCRACGARLLFSTPSSWTTRQVKKAAAVCSLNPDSGHRLRCPVD

SEQ ID NO: 86834 - DNA, 828 bp, Zea mays
  misc_feature: Ceres CLONE 1573497
  misc_feature: Encodes the peptide sequence at SEQ ID NO. 86835
ggagctccccgcggtggcggccgctctagaactagtggatcccccgggctgcaggaattcgtctcacccctagaaaaaacatccgctcccggtcttccgcttccctaccccccgcatcacctaccaacgccgactccatgggggcctttcgcgaaggacgagcaccaattcctagccgagcgtcggcctcgcgcagcgcaacccaagcgcgttcgcatgcagtgcgtggggcggctcacgtcccaccgtcacctccacgagcccgaccaacaatcacgtcatcacagacgtcgtggaggcgtccgtgtcctactacttaggagggcatgcgcgcctgcttctatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatctgtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttgatttcccttgtgctgagcttggttggaatgcttgcattgctttggactgtggaaaatgtgtcatctggaaaggtgctccaacgactccacctgatcgctattgcaatgaccaaaataacggctagtgtattggcagaagacaacgttgctaggcgcaattttaacatcatttttgtgggggcactgcaaatt

SEQ ID NO: 86835 - protein, 144 aa, Zea mays
  misc_feature: Ceres CLONE 1573497
  misc_feature: SWISSPROT Homolog: EC 1.2.1.3 Aldehyde dehydrogenase (NAD(+))
MRACFYAAKTWMAIPAPKRGEIVRQIGDALRAKLHHLGRLVSLEMGKILPEGICEVQEIIDMCDYAVGLSRQLNGSIIPSERPNHMMMEVWNPLGVVGVITAFDFPCAELGWNACIALDCGKCVIWKGAPTTPPDRYCNDQNNG

SEQ ID NO: 86836 - DNA, 797 bp, Zea mays
  misc_feature: Ceres CLONE 1573499
  misc_feature: Encodes the peptide sequence at SEQ ID NO. 86837
ggagctccccgcggtggcggccgctctagaactagtggatcccccgggctgcaggaattcgtctcacccctagaaaaaatacccactaaggattaaatagttccttccccaaccgaacgagtttagatataaaaatatagcatcgcccgcgctctggatagtctggatcctcctgaacctccaagcagcaagcgatgaaaggagggacgccagcaattagcctgatggtgcaccttgctgtgccatggctctgcctggcttcttgggcagctctgctaccagcgctagcatctggaaatgtgggtgcagcagctccgatactgagagcacattacataaaattgaacttcagcaccgcttcggcgacccccgacaagtacaagagcttcatcgcttctgttcgtgctggcttggtgagcaaagcggggggcaacagcagcgggatccccgtgctggtcgacgaacacaacccgctcgcgctcgaatcgtttctaaacatcactctggtgaataaggcagggcgctccgtaatcttgaagatggatgtctccagagcctacttcgtggcttaagtagctgggaagagctcgtggctcctcaagagatcaggccgcacggtctcgtcggcaatctgttactacggtggcccgcggggaacaaggtcggctcctgacacgcgacctgctgctgctgcccgcgacagcgatgatcatggggtcgcggcatggagagcgaaaaatctcgaagaggccatctcggccctggtccttgttccacactggcaacgctaccgaagt

SEQ ID NO: 86837 - protein, 125 aa, Zea mays
  misc_feature: Ceres CLONE 1573499
  misc_feature: SWISSPROT Homolog: EC 3.2.2.22 rRNA N-glycosylase
MKGGTPAISLMVHLAVPWLCLASWAALLPALASGNVGAAAPILRAHYIKLNFSTASATPDKYKSFIASVRAGLVSKAGGNSSGIPVLVDEHNPLALESFLNITLVNKAGRSVILKMDVSRAYFVA

SEQ ID NO: 86838 - DNA, 1249 bp, Zea mays
  misc_feature: Ceres CLONE 1573500
  misc_feature (11)..(11): n is a, c, t, g, unknown, or other
  misc_feature (64)..(64): n is a, c, t, g, unknown, or other
  misc_feature (65)..(65): n is a, c, t, g, unknown, or other
  misc_feature (1249)..(1249): n is a, c, t, g, unknown, or other
taaaaaaaatngaatgggagcgacgaaaaccattaatcttccgacgctaaagaaaccttccatnntttataacgggactccccgcggtggcggccgctctagaactagtggatccccctggctgcaggaattcgtctcacccctagaaaaacactccctcccggcccctgttctctctctcgtggtcacggcgacggctacgactgggcggccgttgctgccgccctactcggcaggtgcccagggattcttcggccgcttcctcggcgactagtgccaccacgttcctcctctccggaacccagtgcaaagtcagatcgatctcgggccagcatgggcctcacgacttgactgccaagggcacccaaccatgcaggctgactacatctatacggttgcgtggaccgtgatcatactccggggctggttcgtgtttcttgcactgcgcaagctaggatctggtacgatcggtttttaaaggaccaagcatgcccatggcatcctctatcatgctaagtggacggggacatgcacgtcagttctagcataggtgtcgattacccatttaaaccatgatcactgtattcccttcgttaacccccaagaaaagcctgaataaaatcttctccttgcttgaagcggaagtaattaagactggggcttgaacccctgttaaaaacacgtggaaaactgttactggctttagttggaatttagcatgagaaaaaaaaggggccaccgggagacataattactcggcggttcaataacacccaaaaggtttcccggccacacacctttttggtctccccccacaaagagagataacttttaggccacaatcctctctttcaagaaagtgggtagcccaaagggattgtgataactccccccagtggtctggcccgaacctaacaaacattgctctccgtaatagaaaacaatacctctcgtactccggagatacattgtccggttgggagggttatacgacccctcttaaatggggggtgaggggacatctccgacacacaattgggtgcgtgcaatgccggtggggacatgaaccataatgtctctcctttgtaagatgctcacagataaactccctctcatagactaataatacctaaaaagagaaacaacacccctctgacgcggtggcttgtgtggaaaaggcttcctcgagtaattattttgttacgaagcgcacatattgtttttatgctaatatattatccgcacgtgn

SEQ ID NO: 86839 - DNA, 904 bp, Zea mays
  misc_feature: Ceres CLONE 1573501
  misc_feature: Encodes the peptide sequence at SEQ ID NO. 86840
ccccgcggtggcggccgctctagaactagtggatcccccgggctgcaggaattcgtctcacccctagaaaaaatccggagctccccgtaccataaccgcagtcggcagccattggaatttccgcttcatgcgtggatcctcgtagacaccgacccgcgtgcactcaatccctaggcggtggcctccagcgccacgctagcgggcggcacccatggcctctgtggcagacctcagggagaagcacgccatagctacggcgtccgtgaactccctgcgcgagcgactccgccagcgccgggagacgctcatcaacaccgacgtggctaggtactccaaatcgcatgggagggtgccggagagcctcaaccctacggatctggtctgctgccacacgctgcagggtcaaaccggataggtatattctcaggattggacctctgaaaagaattggatagtcagtgcctctcaagatggacagctaattgtggggaatgcattgacaagccagaacacacatatcataaagctgcattgcccatgggaactatggggcggtgcttttgcacccaaatggccaattctggccccctgcggtgggtctttgtaaaggggcgtggctcctatttccaaacccacatttgctcaagccgcacccgaatatggggaaacccggcggggaggccccgaaatttttgacctcgaaacccagggggtttggttctacaaccatgtcacaggaggttcccaggatacgggggaaaacaagtgctttaattacctggcttcaaaggtgtattcaaacacactgcggtttctctttggcggaaaggtttaccccacccgcccccgggagggaaaactcccaaacaattgtgggagagaggtgaaacccctccccataaaa

SEQ ID NO: 86840 - protein, 67 aa, Zea mays
  misc_feature: Ceres CLONE 1573501
MASVADLREKHAIATASVNSLRERLRQRRETLINTDVARYSKSHGRVPESLNPTDLVCCHTLQGQTG

SEQ ID NO: 86841 - DNA, 775 bp, Zea mays
  misc_feature: Ceres CLONE 1573502
  misc_feature: Encodes the peptide sequence at SEQ ID NO. 86842
tccccgcggtggcggccgctctagaactagtggatcccccgggctgcaggaattcgtctcacccctagaaaaagagcagcagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatcagtgaagaggatgatgatgatgattctgtttcggagagctcttcagcatcattggccaaaccagctggaactttggatcttggcaagctgacagaggaaccacagcctcaccgcagtgtggatccaaaccattcgtatgatcaagtgtttattagatccactcggttactggagaggagatccaagaaacgcaacggcgggcaacggggctttgggatac

SEQ ID NO: 86842 - protein, 161 aa, Zea mays
  misc_feature: Ceres CLONE 1573502
MIHDTSSSRASTACHYSPSLVAEEQLHGSKDTLTLKGEKALLELLLGMALDQHVDGRKLITQQEAEDSDFESYLREATSRVLYQPTFISEEDDDDDSVSESSSASLAKPAGTLDLGKLTEEPQPHRSVDPNHSYDQVFIRSTRLLERRSKKRNGGQRGFGI

SEQ ID NO: 86843 - DNA, 878 bp, Zea mays
  misc_feature: Ceres CLONE 1573503
  misc_feature: Translation starting site: 149
  misc_feature (878)..(878): n is a, c, t, g, unknown, or other
ctggagctccccgcggtggcggccgctctagaactagtggatcccccgggctgcaggaattcgtctcacccctagaaaaaagcagcagcacagtcatccacactaacgaacgaactgaggtgcgacgacgactgatcgagcagcgactatggcggctgtgctgaccagcaggaagacgccacatgtggttgccgtgctggtggcggcggcgctgctggtgtcggccgcttcggcggcgatcacctgcgggcaggtggggtcatcgctggctccgtgcatcccgtacgccacggggagggccagcgcgctccccgcgtcgtgctgcagcggcgtcaagagcctcaacaacgcggtcgcggaccagcgcggaccgccaggcggcgtgccgctgcctcaagagcctcgccaacagcgtcaagagcgtcaacatgggcaccgtcgccaccatccccggcaagtgcggcgtctccgtcggatttcccatcagcatgtccaccgactgcgtcaagatcagctcagttatacaacgaccaagctcataagcctaccgaacgcacacgtacgtcccgcgcgctacacgagtgatgaagccagtgaagaaatttaataaagctagctgtattgccaggagcaacttgcagaatcgatctatatatatactgaactgcaggcccactattatatcatgtatgtgtgggctcgcaatgataaattggctttcaaatgcaaccctatttggtttttgacaggattaaaaggggtattgggtggcctaaagagaagaaaaaacgggccctccctggtatcatcggccctcgatatccccccattttccttcccacacctcccttccgtagcatgaggtcctcaccctttgn

SEQ ID NO: 86844 - DNA, 843 bp, Zea mays
  misc_feature: Ceres CLONE 1573504
  misc_feature: Encodes the peptide sequence at SEQ ID NO. 86845
ggagctccccgcggtggcggccgctctagaactagtggatcccccgggctgcaggaattcgtctcacccctagaaaaaaaaaacaaccgtcgagcttggcaacgccttacgcctccacactcaacagtcatggtcgtcatgggccaggaacatcaactccaggaggaggaggtgcaagggaaggtcctccaaaaataactgcaagtcgtccaagagacggcggtgccggtgccttcggatgaggacaaggaggccgaggcggcgctggtgcacacgatctctcagacctggctcgccggcatcgctaagctgccatccctgagccagtaaccggaggtgaacgctctcttcaccgagctcgtgacgggcgtgtataccgggtagcatcgtggacgtggatctgctgggccctgagctacaagagatgcacggcggactgatccgcctctgcgcctacccggaggcgctgctggatgaccactactcctacctgctagtctcgttctacaacccactggaacacctgtcactctttccctacatcaacaacgacatactgttgacccagctggaaaagggactgctggggtggtacgttgcgtgctccagcgcctggcacctgtggccttcacatcgggtcaaggcccgcttcccgcttgaacttccctgggttctctgggggaaaaccaacctttccgggcccccctcctttcgacaaactaaaaaaatttggcccggggagggcccaaggacctcggtgccccggtcgggctttggatattccagaataaaaaggccggggggtcttccaagagcccccgccttttggcggtgtttcccggg

SEQ ID NO: 86845 - protein, 139 aa, Zea mays
  misc_feature: Ceres CLONE 1573504
  misc_feature: SWISSPROT Homolog: EC 2.5.1.43 Nicotianamine synthase
MHGGLIRLCAYPEALLDDHYSYLLVSFYNPLEHLSLFPYINNDILLTQLEKGLLGWYVACSSAWHLWPSHRVKARFPLELPWVLWGKTNLSGPPSFRQTKKIWPGEGPRTSVPRSGFGYSRIKRPGGLPRAPAFWRCFP

SEQ ID NO: 86846 - DNA, 964 bp, Zea mays
  misc_feature: Ceres CLONE 1573511
  misc_feature: Encodes the peptide sequence at SEQ ID NO. 86847
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (23)..(23): n is a, c, t, g, unknown, or other
  misc_feature (54)..(54): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (106)..(106): n is a, c, t, g, unknown, or other
ggggggggggtnnnngggtgggnctcgagccacagaggcacccttccggatttnagggttttggggggggtnnnnccaaactgggactcccgcggtggcggccgcnctccaacagtggatcccccgggctgcgtcactcgtctcacccctagaaaaaaaccccttccttttgctctcccgttgcgcgcttctcctcctcctcctcacacccctctctttctgtcggcggcgactgggcggccgtcgctgccgtcctacgccagctgcccaggtcttcctcgcgcccttcgccggcggcaaccaccgccagggtaagccagccatcagccatggctttgaaggcgagctccagcgacaaccggaccaggagcacggtatccctgtgcatagtgattggcatgtgctgcttcttctacatcctcggggcgtggcagaagagcgggttcggcaagggggacagcatcgcgctggaggtcaccaagcgcaccgactgcaccgtcgtgccgaaccttagcttcgacacccaccattctaaagccagtggcaactctagcagcctggtttctccgtcgaagaagttcaagccgtgccctgatctctacacggactacaccccctgccaagaccagaacagggccgatgaagttccctaaggaggaacatgaattacaggagagcggccattcccgggcccagaaaggaggaagctggcactgatttgggtttccaccccccaaaaagggctaagtggggctcccgtttccccgggggcccgaaaaaacccggggaaccaatggtcccccttttccgcgaaaattggccccaataataaagaaagccttggaacacgctccgaagaaataagcccaattccaagaaaaatggggggtgcccaaataaagggaagggggggaaatggtaatttttcccggaagggcgcccccatggagatgaagaaaaagcg

SEQ ID NO: 86847 - protein, 107 aa, Zea mays
  misc_feature: Ceres CLONE 1573511
MALKASSSDNRTRSTVSLCIVIGMCCFFYILGAWQKSGFGKGDSIALEVTKRTDCTVVPNLSFDTHHSKASGNSSSLVSPSKKFKPCPDLYTDYTPCQDQNRADEVP

SEQ ID NO: 86848 - DNA, 1167 bp, Zea mays
  misc_feature: Ceres CLONE 1573513
  misc_feature: Encodes the peptide sequence at SEQ ID NO. 86849
  misc_feature (12)..(12): n is a, c, t, g, unknown, or other
  misc_feature (14)..(14): n is a, c, t, g, unknown, or other
  misc_feature (17)..(17): n is a, c, t, g, unknown, or other
  misc_feature (53)..(53): n is a, c, t, g, unknown, or other
tacccactcgtnangtncggcgagcccccctttacctcttttgaattgcgaanccacacgtctatgtcgcccgaaacgggagctcaccgcggtggcggccgctctagaactagtggatcccccgggctgcaggaattcgtctcacccctagaaaaaactccatcttgtccgccgcctcgctgtggcgtggggccaatgcgtgcgtgggggccggcctgagtgactggcatctcctcggcgcgcggacccaggggaggcggcgatggggaagaatatgcacatcaagacggcgctcaaggcgaaccgtgtccacctcctcggcgacggggagacgtcaagggggctctcggacctgcttgagggcagccacgtccagccagcgaacgtctgcttcggtcgcgtcatcaaacttgcgaagcatgacttcggacagctggtcctcgctgccgcggcgctgctcgtcgcctcgctcagcaacgttctcgttcccacatatcgaggaaagataggtgacattgagtcaagagatgttctggcgcccagaagataaggctcaatactctggaaggaatgtgaaagggccacagttcttgaaacatatggtggacaactcactccttacagggggttccacattggccgccgggctcctttcgggggacaaggggcctagtgtaccaatttcctggccttgagttgcccgaacggaaaataagtccctccgtcctgcaaggtgaaggcggaagaaagcgatttttggctattgccacgccccggaatctctttccatttccaaaccccccaagtgggaacaaaaataggcgcgcctctcttttgcctgtggggtgggtggaacacctttaagtatagacagaggggtttgaggggtacctttccaagaagattcaggcgcgtttgttcccggcccgagggaccgacccccaataaaatgtaaaattgacaagtacaataggccatgtgttatgcaagaggccccgatcgcctgaatatcgcggaaggggttactctgacccgccacttttgggtgttactttattcgagccgaaaattaatgtggggaacacccgggtgtatatcaaagatttacttctcagacctcttattggcgacagttgttaaaacccgtgacgcccgcgcggacaaaag

SEQ ID NO: 86849 - protein, 95 aa, Zea mays
  misc_feature: Ceres CLONE 1573513
MGKNMHIKTALKANRVHLLGDGETSRGLSDLLEGSHVQPANVCFGRVIKLAKHDFGQLVLAAAALLVASLSNVLVPTYRGKIGDIESRDVLAPRR

SEQ ID NO: 86850 - DNA, 777 bp, Zea mays
  misc_feature: Ceres CLONE 1573517
  misc_feature: Translation starting site: 141
ccccgcggtggcggccgctctagaactagtggatcccccgggctgcaggaattcgtctcacccctagaaaaactctcgatccggaaacctctcaaaccctagccgcctcctgcgagttgcagagctcaagaatctgcaccatggcgagtgagacggagacctccgcatttcaagctgagatcaaccagctgctctcactcatcatcaacaccttctactccaacaaggagatcttcctccgcgagcttatctccaactcttccgatgcgctggacgagatcaggttcgagagtctcactgacaagagccagctcgatgcccatcctgagcttttcatccaccttgtcccagacaaggccacgaacacactctccatcaccgacagcggcatcggattgaccaagtccgaccttgtcaacaacctcggtaccatcgccaggtccacggaccaaggagttcatggaagcccttgctgccggcgctgatgtgtccatgattggacaatgccgcgtcggtttctactctgcctacctccacgccgatagagttgtcgtgaccaccaagcacaacgatgacgagcagtacgtgtgggagtccccagcgggcgggtcgttcactgttactcgtgacacgtcacgggagcagcttggcaggggtactaagatcccactgttcctccaggacgatcatctggagtaccttgaggagcgtcgcctcaaggatctagtcaagaagcactctgagatcatcagctaccccatcttcctgtgggactgc

SEQ ID NO: 86851 - DNA, 1128 bp, Zea mays
  misc_feature: Ceres CLONE 1573518
  misc_feature: Encodes the peptide sequence at SEQ ID NO. 86852
aggagaaaatttataaattaaaaaagggggccgttttgtcctctgttcttcttttttcccttaaaaaaaataaagctggagctccccgcggtggcggccgctctagactagtggtatcccccgggctgcatgaattacgtctcacccctacaaaaagacatgcacagggacttgtcctatggttatgatacgttgatggagaacgtctctgagccgtcccatatagaatttgctcaccacaaagttactgagagaagagagagagccacgcctttgacattcaggatggaatcaagtggtgcctggggttactcaggagcaaattctggtaatcctcgcattcctgcaatttctgaggccccttgttatgcattgaaccaagtggagatagacacaacgatgcccattttgagcgaccagaactgggtggcatggatttgctcttacaacattccaatggccccaggggaagactcgttctatagtctgtagcgctcgaaactttttcccagttccattgccagggaaaagcatggtaggcagttttgtgcactcggtggaatgaaacatgggaacttcaaaatttgggtctatgaatgggccggatatgaatcatttccttacaagggccacgcgagaaagatttttatccctagcctggccaacccaacgggaggttctttcctaaccgggattattaaaacttccctcctcccttaactacaaaaaaggatttccccgaatttcgcgagcggagcgcccatccagcttaaacgccctggggaatcccgaatcttttggatataaagagacccaattctgcccgacaaataatggagggtatcaaaaggggaaaaattctttggagcaaattaaaccccccccctcccgggaaacaggagctatatggaaaaaaactctctgttacaatataagaaaggaaaattggcggtttgtggaactccaatcagatttttaaaaaaccgcccataagaacttcttggaaaacagagattccctacccacccctcaaacgttttggaaaatggcgtgcgtaagagtgccaaagggaggtgatttctaatgtcattttcctgaaatatctgggttgaaggtgattatccgggg

SEQ ID NO: 86852 - protein, 110 aa, Zea mays
  misc_feature: Ceres CLONE 1573518
MHRDLSYGYDTLMENVSEPSHIEFAHHKVTERRERATPLTFRMESSGAWGYSGANSGNPRIPAISEAPCYALNQVEIDTTMPILSDQNWVAWICSYNIPMAPGEDSFYSL

SEQ ID NO: 86853 - DNA, 827 bp, Zea mays
  misc_feature: Ceres CLONE 1573520
  misc_feature: Encodes the peptide sequence at SEQ ID NO. 86854
tggagctccccgcggtggcggccgctctagaactagtggatcccccgggctgcaggaattcgtctcacccctagaaaaaacacgcacggacggccccgagggtttagagcccaacttctctcttcacatcgccgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatattcaagccaagaacttggcagctattagagcattcggcagtgaagggaaagtgaagggtcaaagtactgttctgccaattgaagttgttcaaccttctggagctcccccggagctgacattcttttcagcattgttgcccaaacctttggaaaaaggaaagactctgtacttggatgttctgactgtgttcacacactctcttgcaccattcccagaagaaatcactcaagccgaagcacaacttgttgtctatcaggatagtgctcactatctgtcaccttaccctggtaaggctcagacacttgctatcagattgcctgggtggaagggtttgaatcctacaccaggcatccaaacgcaaaaacttgggggattccgaactgaaatatggacccttttcaggaacttcccccccgttctccctacttaacctggggt

SEQ ID NO: 86854 - protein, 215 aa, Zea mays
  misc_feature: Ceres CLONE 1573520
  misc_feature (30)..(216): Pfam Name: Ribophorin_I Pfam Description: Ribophorin I
  misc_feature: SWISSPROT Homolog: EC 2.4.1.119 Dolichyl-diphosphooligosaccharide--protein glycotransferase
MATPPPPIRPAAALLLLVLAGVLASAASADLVISKADRRVDLTSHIVRVLASLKAENVGPDPVSQVLLPFPNIQAKNLAAIRAFGSEGKVKGQSTVLPIEVVQPSGAPPELTFFSALLPKPLEKGKTLYLDVLTVFTHSLAPFPEEITQAEAQLVVYQDSAHYLSPYPGKAQTLAIRLPGWKGLNPTPGIQTQKLGGFRTEIWTLFRNFPPVLPT

SEQ ID NO: 86855 - DNA, 828 bp, Zea mays
  misc_feature: Ceres CLONE 1573522
  misc_feature: Encodes the peptide sequence at SEQ ID NO. 86856
ccccgcggtggcggccgctctataactagtgaatgccccgggctgcaggaattcgtctgacccctagaaaaactacgtgctgagccggtcagtgctgggttcgacccaccggaagaaaggctcgaacatggtgttcagggacatgaccatgaccaacgtgtacctcctggtggggttcaacctggagtactacatcccccggtggccgctgacggacctgctcttcaggctcgtgtgctggaaggtcacgcgccacctcgagcgctgggacgccctgctggaggaggtgatccacgagcacgtgtagatgaggaagctgtccggcgacgaggagaaagagtcggacgacttcatcaacatcttcctctccagatacgaggagtacggcttcaccatggataacgtcaagtccctcctcatgaacgtgttcgaggcagccatcgagacctcatatctggtgctggagatcccccatggccgagctcatgaaccacaggcgcgtcattaagaagcttgcaaacggaggtactggccgtactgagcggagaagaagctggacatgaatctgggaggacgacctgagcaccctggccgttacctaaaggtgtccatgaaggaaacagctgcgagttgcatcaatcgggggccccctggctgcctcccggattttattccaccggccgtaattgcctgaatcgaagggggtaaccaacaataccccctcccaaaaatcgggcgaggttctttgccttgaaaaaggcgtggggggcccattgtagggaaagaagaaaccccggagcggagttcttgtgggaaagaaaagagacc

SEQ ID NO: 86856 - protein, 59 aa, Zea mays
  misc_feature: Ceres CLONE 1573522
MVFRDMTMTNVYLLVGFNLEYYIPRWPLTDLLFRLVCWKVTRHLERWDALLEEVIHEHV

SEQ ID NO: 86857 - DNA, 793 bp, Zea mays
  misc_feature: Ceres CLONE 1573528
  misc_feature: Encodes the peptide sequence at SEQ ID NO. 86858
  misc_feature (647)..(647): n is a, c, t, g, unknown, or other
  misc_feature (648)..(648): n is a, c, t, g, unknown, or other
ctcaccgcggtggcggccgctctagaactagtggatcccccgggctgcaggaattcgtctcacccctagaaaaaacacacgtccccgtctccctgtatccttctgaccctctcgccaccgacaggactacagccgctgtctcactacccctgtcgcccaggtatctctgactcctacgaccatctgccagggacatgggaatccaggtccctcgtgcccagaccgcaccaccaaacataacaatctctgatcatgtgaatcttttccactagaatgaacacgaatacctgctaaagaacatgacgaggcagctgtttttggttcaaacacaactaccaatctcactgtatctggcacctcctaccgatgtgaagcatgagtggcctgaacctaagctaacttatgccttctacttcattatggtccgctcatttgacgatcctaaactgacgtgaaaactctaccaaactgactcaaaattccaaacgaagatcctggctcgatctacacttatcaaagcagcaaaagcccacaaggcagagcgcaccagtaaatatcgcgaagctgatgacattgcacctctgacaacgagccatataataataggctgtgaatgagaagatcaacgagatggagcctcttccccnncccttgcccaaatttcgggatgaaaacgctgccgagataccaacagagtgcacgtccatgcgtcttctaccctaagacggttgacctaaccaatcactatgctcttatgattcaatccgaacctgaaaagcattcccttttatcg

SEQ ID NO: 86858 - protein, 51 aa, Zea mays
  misc_feature: Ceres CLONE 1573528
MTRQLFLVQTQLPISLYLAPPTDVKHEWPEPKLTYAFYFIMVRSFDDPKLT

SEQ ID NO: 86859 - DNA, 1210 bp, Zea mays
  misc_feature: Ceres CLONE 1573530
  misc_feature: Encodes the peptide sequence at SEQ ID NO. 86860
  misc_feature (13)..(13): n is a, c, t, g, unknown, or other
  misc_feature (54)..(54): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (1091)..(1091): n is a, c, t, g, unknown, or other
atcgaaatagaanctcgcccctccctccccacaaaactcttctccatccccccngagagancnnnnnnannnaaactggagctccccgcggtggcggccgctctagaactagtggatcccccgggctgcaggaattcgtctcacccctagaaaaacccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttacacaaggatggctcagctatcaagaagctccagactggagtcaataagcttgcagacctagtcggagttactctcggaccaaagggaaggaatgttgtttgggagagcaagcatgggtgcacctaaaagtggtaacaaaggtggttaacccttgccctcgagaggtttgagccggaaggaaccccgatggagaaacatcgggtgcttcaaattgggaccagggtgaagcagaggagcttaggaacccaatggaattctagccttggggagaaagtggggaccaaaaccaacccgacaggggggggtcccatatcgctttaaagggggccctgaagaacgccatagaaaggggtagggttaaaagaggggtatgtgttgggccccaaaactctgggggcgggcgcatatacaacatcccccgcgtgtttttcacgaaaaatttcaccgctcgcgcgaggggaggggagagaacgggggagaaaaaacaaacctaagggcgtgaagagaaggcgctcgccgatgggagttggagaaaagaaaacacctttagcgggggagaagtgtttggtgcccactaaaaggagaaaggtgtcgtttaaaaagaataagtgctggaggccctattggaataggccatggggtatgcagctggccctgtgattcagccgcgagcccggtggtcaactacactcgctcacgagaaataatgggngtgtgataataatgaaaaagttgccccgccggccaccttagtagagactcagaggccctcgcacgctcgggaaaagggggagggtggatacacccccacttcgcgacgaaaggggaggg

SEQ ID NO: 86860 - protein, 81 aa, Zea mays
  misc_feature: Ceres CLONE 1573530
MASTFGATSTVGLMAAPTGKNVRLQRRVNFRVRAAKELYLHKDGSAIKKLQTGVNKLADLVGVTLGPKGRNVVWESKHGCT

SEQ ID NO: 86861 - DNA, 889 bp, Zea mays
  misc_feature: Ceres CLONE 1573531
  misc_feature: Encodes the peptide sequence at SEQ ID NO. 86862
  misc_feature (851)..(851): n is a, c, t, g, unknown, or other
ccccgcggtggcggccgctctagaactagtggatcccccgggctgcaggaattcgtctcacccctagaaaaaacccccgccacgacccctcagtcctcacacaagagacgcagctgcgagtccgccagccttatcctcctccccgtctccggctccaacccgcaagcgcggtaaggcatggcttcgacattcggtgccacttctactgtcggccttatggctgctccaacagggaagaatgtgcgccttcagaggacggtgaacttcagagtaagagcagctaaggagctgtacttcaacaaggatggctcagctatcaagaagctccagactggagtcaataagcttgcagacctagtcggagttacactcagaccaaagggaaggaatgttgttttggagagcaagtatggttctcctaaaattgttaacgatggtgttacatttgccagataggttgagctggaggaccctgtggagaacattggtgctaaataggtcaggtcagcagcggctaagaccaatgatctagctgggagatgggacaaccacctcagtggtccttgctcaggggctgatcgctaaggtgttaaggttgtggcaactggtgctcatcctgctcagattactcgggggtatcgggaaaaccggcgaaaggccttatttgaaaaaattacggaaaattatccaaaggaaggccgaaaaaatactcagccttgtcccaatatttgcctgcctggtaaagtcgccggggcaaacaaccttaccaaaaataggtgtaaaaattggaatgcggcggaagtgcccccttggaaatcaaaggggtccggaagttcctgaaaaaagggagngtggtgggatttaccccaccattgggagaaaaaaaggg

SEQ ID NO: 86862 - protein, 92 aa, Zea mays
  misc_feature: Ceres CLONE 1573531
MASTFGATSTVGLMAAPTGKNVRLQRTVNFRVRAAKELYFNKDGSAIKKLQTGVNKLADLVGVTLRPKGRNVVLESKYGSPKIVNDGVTFAR

SEQ ID NO: 86863 - DNA, 845 bp, Zea mays
  misc_feature: Ceres CLONE 1573537
  misc_feature (845)..(845): n is a, c, t, g, unknown, or other
ggagctccccgcggtggcggccgctctagaactagtggatcccccgggctgcaggaattcgtctcacccctagaaaaagcaaaagctgctcatcaccgacgatggtgacacggctaacacaagcaagcgagcaagtcactgagtagctaggagtatataccaccataaaaacaacacacacgcacacgtgcgctaataagctaagcttaacgcggtagccgtagctcctatcgatctccggctcggacggacgacggtgccatggctgctcaactgcatcgcgcactatacgagactgatgcacgaagcagcatcagcgcaacgagctctgctgatcgcgatcaccttctccctgctgctcctgacgctcctgctccgctacctcgcagcgtcggcgtctgcgtcggcgacgaataacgacggagcggcgccgagccagcgaccccgacaagcacttgagcctgctgactgcgccgcccatgaaaatccccgtcatcgagcagctgcacctgatgggggacatcccctacgtgtccctcgacgcgctcatcaccaggtagggacacgacctgatgatgctcctcatcggcgtcgtgcagaccgaggcggactcgtcaccgcgcatatccgatgccgaggtacgcaccaacgatcacgtcttctcctgccgaccagcgctccatggtgaccgacatcatcatggtagggtgccaccgacatcgtgcatacctgcccaaaagataacagcttccgcaagggagcggaaaaactgaaaaacttggaaccatggggaaaaccccagcaaagctccggggccagatgctcctacaggaaaaaaaaaaaan

SEQ ID NO: 86864 - DNA, 835 bp, Zea mays
  misc_feature: Ceres CLONE 1573540
  misc_feature: Encodes the peptide sequence at SEQ ID NO. 86865
  misc_feature (835)..(835): n is a, c, t, g, unknown, or other
ctggagctccccgcggtggcggccgctctagaactagtggatcccccgggctgcacgaatgctctctggaccggaggaacaagctgccccgcgcgcacacggagcgggagatcctgggcctgctcgaccaccccttcctgcccacgctctactcccacttcgagaccgacaagttctgctgcttgctcatggagtactgctgcggcggcaacctccacgcgctccgccagaagcagcccaacaagcgattcaccgaggacgcagccaggttctacgcctctgaagtcctgcttgcgctggagtacctgcacatgctgggcgtggtgtaccgggacctcaagcccgagaacgtgctcgtcagggaggaaggccacatcatgctctccgacttcgacctctccctgcgctgctccgtcagcccggcgcttgtccgctccccgtccggccgggtcagcggaggcggcggcctcgcccacggctgcatgctcccgcgcatcctccaggtgaagaagaagaagaagggagacaaggctaataaggccaataagctggacaaccgagacggtgactagcaagaagccgtcgtcgctgggagttcacagccgagccgacaagcgcgcggtccatgtcgttcgtgggcacgcacgagtacctggcgccggagatcatccgcggcgagggccacggcaacccccgtcaactgggtggacttttgggtatctttccccctacgaacttcctgcaacgggcggccacggccgtttcaaggggcctccggggaacacgcgcccacaggctctttcaaacgtttcgtttccggacaacccgcctttan

SEQ ID NO: 86865 - protein, 189 aa, Zea mays
  misc_feature: Ceres CLONE 1573540
  misc_feature (19)..(183): Pfam Name: Pkinase Pfam Description: Protein kinase domain
  misc_feature: SWISSPROT Homolog: EC 2.7.11.1 Non-specific serine/threonine protein kinase
GAPRGGGRSRTSGSPGLHECSLDRRNKLPRAHTEREILGLLDHPFLPTLYSHFETDKFCCLLMEYCCGGNLHALRQKQPNKRFTEDAARFYASEVLLALEYLHMLGVVYRDLKPENVLVREEGHIMLSDFDLSLRCSVSPALVRSPSGRVSGGGGLAHGCMLPRILQVKKKKKGDKANKANKLDNRDGD

SEQ ID NO: 86866 - DNA, 819 bp, Zea mays
  misc_feature: Ceres CLONE 1573542
  misc_feature: Encodes the peptide sequence at SEQ ID NO. 86867
gtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggtcgagatggcgacgccgaacgggcttgcgcggatcgagacgccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcaaagggcgaggccgccgcgcagggcgcgccatcgacgccgagggcgcaccagcagcaccgccaccccgccgcccccgccatcgtcgtcagcgacagctccctcaagttcactcgtgtgctcaacaacctctcgcctgctgagctgtacgagcaggccatcaagtacgaggaggggtcgttcatcacgttccacggagcgctagtcaacactgttctggtgccgagaccgggcggtctcccagggcacaagcgctgtcgtccaggacgagggtcaccgcctcagggacctggtggtggggggaaagggctcggcccaaaccatcaagatggcactgagaaagaca

SEQ ID NO: 86867 - protein, 272 aa, Zea mays
  misc_feature: Ceres CLONE 1573542
  misc_feature: SWISSPROT Homolog: EC 4.1.1.49 Phosphoenolpyruvate carboxykinase (ATP)
GGRSRTSGSPGLQEFVSPLEKTTAWRFITRSLSKARARTSVVPSRTSIGRDGDAERACADRDAGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIVVSDSSLKFTRVLNNLSPAELYEQAIKYEEGSFITFHGALVNTVLVPRPGGLPGHKRCRPGRGSPPQGPGGGGKGLGPNHQDGTEKD

SEQ ID NO: 86868 - DNA, 873 bp, Zea mays
  misc_feature: Ceres CLONE 1573543
  misc_feature: Encodes the peptide sequence at SEQ ID NO. 86869
tggagctccccgcggtggcggccgctctagaactagtggatcccccgggctgcaggaattcgtctcacccctagaaaaaaaaacctcccatccgccattgctaatgcagccactcctccccaaaccacgggatctatgctactccctcctccattcggcagtgccgcgtggcacacctatatagaaacacccggactctatactccccccggatcgccaccacccgtcccgacgaattggaatacggaaagcgaaagatgatggatctcgccgacccccagcagcagcagcggctcatcggcggcgcggcgctgctgctggcaaccgcgggcttcgtcaggatcctcctgggctcccgctcccggggcggcaagctcctgccgcccaccatcaagggagcgccggtgatcggaggcctcgacagaggcatgcccgggcccatccccatgagccgggagcagtacacccgcctcggaagcggcttcaccgtccgcatcatcacccgcaagatcacgatcctcgtcggcccagaagtgtccgcgcacttcttcaagggtaacaaggccggatatgagccagcaggaggtgtatccgttatacgatgcccacgttcggcacccagcggtcaacatttcgaagtctacaaactccgtcaagcacggagccatggcagggctcatttaccgatggcccttccgggcaacaaaaacctggcgcaaaatactggcggaccaggatgggttgcacttaggcctgtaagcagtacttttctccaaaaaagggggaagaaaagcgggcacatgtttgaaatttgaaggtaaagaagtatgggaagcaacccccattaataacttgaactggccatattcccgg

SEQ ID NO: 86869 - protein, 185 aa, Zea mays
  misc_feature: Ceres CLONE 1573543
  misc_feature: SWISSPROT Homolog: EC 1.14.13.70 Sterol 14-demethylase
MMDLADPQQQQRLIGGAALLLATAGFVRILLGSRSRGGKLLPPTIKGAPVIGGLDRGMPGPIPMSREQYTRLGSGFTVRIITRKITILVGPEVSAHFFKGNKAGYEPAGGVSVIRCPRSAPSGQHFEVYKLRQARSHGRAHLPMALPGNKNLAQNTGGPGWVALRPVSSTFLQKRGKKSGHMFEI

SEQ ID NO: 86870 - DNA, 852 bp, Zea mays
  misc_feature: Ceres CLONE 1573546
  misc_feature: Encodes the peptide sequence at SEQ ID NO. 86871
  misc_feature (852)..(852): n is a, c, t, g, unknown, or other
ccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccacagaagaggaggaggagaagaataagatgagcagctgcctctgccttccgaaaaaaaaggaggggccagcgaaggagaagccgtccacagatacccccacctcgtcactccttcagaagcagaaaccctcccaaactccacctcctgaatccaaaggttcctccgagggcatggaccccaccctcgagcacttgaagagcgggtacccgatgttcaggaccaaggtctatgaccagaactccgaagctgtacgaacctctcaaggccggaccgaaccccccggtacatggtggctcgcaccgctccaaatcccggcgtgtgcccagggggctgaacccttgggccaagcaggcccggccgaggcccttcaacggtaccgccacatgcgccccccatagggtccccccccttgagggacaaagaaaaaaaggcccccccgggtcagggggagcggcacaattttcaataaacccccatatatgtgcctgcgcttcaaagaaggccn

SEQ ID NO: 86871 - protein, 123 aa, Zea mays
  misc_feature: Ceres CLONE 1573546
MSSCLCLPKKKEGPAKEKPSTDTPTSSLLQKQKPSQTPPPESKGSSEGMDPTLEHLKSGYPMFRTKVYDQNSEAVRTSQGRTEPPGTWWLAPLQIPACAQGAEPLGQAGPAEALQRYRHMRPP

SEQ ID NO: 86872 - DNA, 833 bp, Zea mays
  misc_feature: Ceres CLONE 1573548
  misc_feature: Encodes the peptide sequence at SEQ ID NO. 86873
ccccgcggtggcggccgctctagaactagtggatcccccgggctgcaggaattcgtctcacccctagaaaaagtctcacgcttcctgttcaaactcttcgtcgcctcacactggtgctcctcctctccccatcgctccgtcactcccatggcgtccctcttcggggctggccgccggcgatcaccggaggacgacggcgaggatgatgcatccggcagaggcaggaccaagcgcttccgcctctccccggaggaggacgcagcgtcgccggcggaggcggggcccggcgctgcgaccgagaccggctggctctccggcttcctctacggagcgaagagggccatttcttccgttttactgttatctctcgcccgaggagaccagctcgggggatgacgaggatgaggagaacgacgacgactactacgaagagggcatccacttgaatgaacatgaagctactcatgacactcatggagcaatagttccttatagcgagccgaagcttactattgagcacatggttatgaacgacacattctctacggatgaatgtgataggatggtagagctaatacaatcaccagttagagattctacttgttctggaccccatgacaatgataaagcagaagacctccctaggaggaatgcaggcattacacatgacttcacatcaacatagcgctcccttgagccgtgattggaatgttcctgaatccgttccactctctagtatgaaaaacaagaccctggtagttttttctccaggggtactcacctcaaggcatcctcctgaagctaaggccctgggaacagttccccggaaagcc

SEQ ID NO: 86873 - protein, 160 aa, Zea mays
  misc_feature: Ceres CLONE 1573548
MMHPAEAGPSASASPRRRTQRRRRRRGPALRPRPAGSPASSTERRGPFLPFYCYLSPEETSSGDDEDEENDDDYYEEGIHLNEHEATHDTHGAIVPYSEPKLTIEHMVMNDTFSTDECDRMVELIQSPVRDSTCSGPHDNDKAEDLPRRNAGITHDFTST

SEQ ID NO: 86874 - DNA, 750 bp, Zea mays
  misc_feature: Ceres CLONE 1573549
  misc_feature (727)..(727): n is a, c, t, g, unknown, or other
ccccgcggtggcggccgctctagactagtggatcccccgggctgcaggaattcgtctcacccctagaaaaaaactgctatcggattggcgctgcagtggagatcgacccgggctggaatttctttcgttggtaaggaaccctaatttggtcggatgggattttcatcttcgacgaagcccgcgagattgatccaccttagctgacgcgagggattggaaagctaaggctcgggcgtagttaattttctacgaagattggggtttcagctcgaacccccatgctcgatgctgaagacgaccctggcgggagatgacaaggaatctttccgtgccaccgcggggaacccccccggggtttcctttcgttccaaatttttccggggccccctctgggggctttccaaaagattaagggcggaaaaaaaaacccgggggcaaacaaaaatttttggccccccgggggaaaaggaaaaattttttccccccctttttttccaaaaacccccttcttgtggggcccccccgcggggttttttctcctcccgggaaaaaacacccctttttgggggggctatttttttgagcgggaaaaaaataaaggggcgggggaaacacctttttttttataaaggggggggggggggggcctcctcctggggaaaaacaaaaccccccgctgttggttgcgcgcaaaaaaaataaaaacaaagaattttttttttttttncgaggaaaaaaagaagaaaaaca

SEQ ID NO: 86875 - DNA, 807 bp, Zea mays
  misc_feature: Ceres CLONE 1573550
  misc_feature: Translation starting site: 193
  misc_feature (650)..(650): n is a, c, t, g, unknown, or other
cgcggtggcggccgctctagaactagtggatcccccgggctgcaggaattcgtctcacccctagaaaaacttcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtccccaattgaagaggtgatcagcacaggagtcgtgccccgattcattgagttccttacacgtgaggaccatcccacactcccagttgaggctgcatgggcgctcaccaacattgcatcaggcacatcagagaacactaangtgggtgtttgagaatgggtgctgtgcccatcttttgttaagctccctcactccaaaaccgaggatgttcgtgaacaaggctgtatgggctttaagttatggtggctggtggactccccaaagtgccctggatctggtgctaaggccatggttggga

SEQ ID NO: 86876 - DNA, 1118 bp, Zea mays
  misc_feature: Ceres CLONE 1573551
  misc_feature: Encodes the peptide sequence at SEQ ID NO. 86877
  misc_feature (88)..(88): n is a, c, t, g, unknown, or other
  misc_feature (89)..(89): n is a, c, t, g, unknown, or other
  misc_feature (785)..(785): n is a, c, t, g, unknown, or other
ttgggggagtttttaatataacacaacaatcaacttaatatataaaaccaaaccctcccacaatcctaattattataaaaacacccanncaaaaatggagctcaccgcggtggcggccgctctaaactagtggatcccccgggctgcaggaattcgtctcacccctagaaaaaaccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacgacgccggcggcggcaagaagcccaaggagccgaagcagaagaatggtaagaagccgaaccccttctcgatccaattacaccgctcggggcaaggcgagcgcgccaaagctgggggtggctgcggggatcccacgggggccggaacctccccgggcccggtaacgagcttcgggcccggaaactcggggggcccggccaattttccggggttacccttaacctttggcacaaaaaaccggggtgccccccgggggaaaagggggcctgggggccctttttaaaatttttttttctccccaaaagaaaaaaaaaaaacttcctccgaaacaccccgcccgggttgtgagaaacccccttgaagagagaaaacattgtgttcgcccccccgcggggaagaaatgtgtgagaaaaaaaaaatatttatgggngtggggcacacccattgtgttttcccacaaagaaacacccccccccgaccaaagtttttgttttttcctcccccctcctttgtgggggcgaacgcactcctccctcgggggagccacccacacctgtggtgggcggggggggcccccccctccttataaaagagaaaacttcttctccaagagggggggggggaaaaggggggaagtgtatccaccgccgcccctcgcggtgggggggggggggaccccccccccctctggagggggggggggggcgccccccccctggggttttttcccccccaattattttttggggggggggggggaaag

SEQ ID NO: 86877 - protein, 105 aa, Zea mays
  misc_feature: Ceres CLONE 1573551
MGNCCVTPKAADDAGGGKKPKEPKQKNGKKPNPFSIQLHRSGQGERAKAGGGCGDPTGAGTSPGPVTSFGPGNSGGPANFPGLPLTFGTKNRGAPRGKRGPGGPF

SEQ ID NO: 86878 - DNA, 803 bp, Zea mays
  misc_feature: Ceres CLONE 1573552
  misc_feature: Encodes the peptide sequence at SEQ ID NO. 86879
acccgcggtggcggccgctctagaactagtggatcccccgggctgcaggaattcgtctcacccctagaaaaagaaaacagaaggctccggcctccggcatccgccaaaaaggggaaaaaaggagagataacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggaaacgcagcacgaccagatccgcctgctcaagcgcttcaacgtcggcgaggactgccccgtcttcgacggactctacagcttctgccagacctatgcgggcgcctacgtcagcggggccgtctagctcaaccacggacatgacatcgcaatcaactggtcggggggcctgcaccacgccaagaagagcgaggcgtcgggcttctgctacgtcaatgacatcgtgctcgccatactcgagctgctcaagcatcacgagagagttctgtatgtccatatcgaaattcaccattggtgatggaagtgaagaaggctttctaccaaccagaaagggttaatgactggtctcgtc

SEQ ID NO: 86879 - protein, 136 aa, Zea mays
  misc_feature: Ceres CLONE 1573552
MDPSSAGSGGNSLPSVGPDGQKRRVCYFYDPDVGNYYYGQGHPMKPHRIRMTHSLLARYGLLNQMQVYRPNPARDRDLCRFHADDYINFLRSVTPETQHDQIRLLKRFNVGEDCPVFDGLYSFCQTYAGAYVSGAV

SEQ ID NO: 86880 - DNA, 845 bp, Zea mays
  misc_feature: Ceres CLONE 1573554
  misc_feature: Encodes the peptide sequence at SEQ ID NO. 86881
ccccgcggtggcggccgctctagaactagtggatcccccgggctgcaggaattcgtctcacccctagaaaaaagcggaaaagcgccgtctcattcttcttcctccatcttgtctctacttgccccgcgccggggagtcgcgagcgtcgcgccactcccatcgcctgcccacaattccggcatggagccgtcggcgtgggccgtcgccttcgccgcactctgcatcgtcgcgctcgtgccgccggcctccgggttctacctccccggcgtcgcgcccaatgacttcgagaagaaagatccacttcctgtgaaagtcaacaagctgacctccatcaagacacaacttccctactcctactattctctcccattctgcaagccggataccatagttgacagtgcaaaacatctcggtgaagttcttcgaggagatcgcattgaaaactctccctatacgtatgaaatgagggagcctcagatgtgtcaagtagtctgcaagatatctgttggggagaaagaagcaaagcttctcagggagaagattgaagatgaataccgtgtgaacatgattctcgacaacctacctttagtcgttcctaatcacagagtggatcaagaacgtgcatatatctatcaacatggataccatgtggcgggccaacggaaaatattcttggcagcttagatggcaaaatacttcttccacaagcaatctagtcttataccggcgagaatataacacggcatggagcaacgggatgtttttcaaggaattttgggctttatttagtgaaaacccatactcctgtttaaaccgtgccatatggaaagggctaatgctattga

SEQ ID NO: 86881 - protein, 167 aa, Zea mays
  misc_feature: Ceres CLONE 1573554
MEPSAWAVAFAALCIVALVPPASGFYLPGVAPNDFEKKDPLPVKVNKLTSIKTQLPYSYYSLPFCKPDTIVDSAKHLGEVLRGDRIENSPYTYEMREPQMCQVVCKISVGEKEAKLLREKIEDEYRVNMILDNLPLVVPNHRVDQERAYIYQHGYHVAGQRKIFLAA

SEQ ID NO: 86882 - DNA, 845 bp, Zea mays
  misc_feature: Ceres CLONE 1573555
  misc_feature: Encodes the peptide sequence at SEQ ID NO. 86883
  misc_feature (845)..(845): n is a, c, t, g, unknown, or other
ggagctccccgcggtggcggccgctctagaactagtggatcccccgggctgcaggaattcgtctcacccctagaaaaaaccccaccccattctccttcttcctccagagtccagacggcgtgcttccgcctgccgccgccggcgagctgcttgcccgcagcatgactccgcatcctggccgcctcgtcctaccaccggcggctccttctccctgaaccccgccgcgcgccaggcaccacgcctccctccgcagtcacacgagcacgcggccgtcctctgccgcaccgcgccgcctccagacgcctcgctcgtcaggtctctccacctccgcctgcgaacgttcggcccagctccggcgagttcctccgcaattccggatctgctggagcgccagcaaggcggtctctccaaccctccggagtccggaccagcaagggttctgatctcccatgccacagtttataacgttgaaggattcaaaaatctacagaactagatgatacttgcataatgcagtcctcaggtatttggaaggcgcatgctggttcatcacagtcagagggttcgggtctggatatggagaggaacggatgcaatcataattattgtccatctcctctccaacaaattgcctcagctgggcagcactctgaaagcagcgctgcatactttttcttgggctacatctactccaatgcgcgggtcagctgaaggccgtgcatattactttggggaaccttcagaaagggtgtactaccagggcaatcttgggtcccttgccaaaagggccaggaaagctacccaccttaacttgatttaaagggattatgaagaggcattccccn

SEQ ID NO: 86883 - protein, 66 aa, Zea mays
  misc_feature: Ceres CLONE 1573555
MQSSGIWKAHAGSSQSEGSGLDMERNGCNHNYCPSPLQQIASAGQHSESSAAYFFLGYIYSNARVS

SEQ ID NO: 86884 - DNA, 842 bp, Zea mays
  misc_feature: Ceres CLONE 1573556
  misc_feature: Encodes the peptide sequence at SEQ ID NO. 86885
ggagctccccgcggtggcggccgctctagaactagtggatcccccgggctgcaggaattcgtctcacccctagaaaaaatcctcatctttccattccactctcacactctctcgctggtccactttcgacactgatcgggactgctagtgtccgactcgtcacaattttagcgagaaacgagcgagcgagcgagggagaggatgggttccacatgaccggctagcgggtacgcggagccggagcgggacatcgacgatctgccgcggaacgacgccaactacacggcgctcacgccgctctggtacctcgagcgcgcggcactggcgcatcccggcagggcctccggcgtgcacgggcccgtgcgctacacctgggctgacacctatcgccgctgccgccgcctcgcatccgccctcgcgcgactatccgtcggccacggaagcacggttgctgtgatagctcctaaagtaccggctgtctatgaagctcacttcggagtaccaatgtcaggagctgtagtgaactgcgtatatattccgctaaacgccgagacaatagcattcctccttgaacactccgtggcagaagttgtgatggtgcaccaagaatgcttcaccctagccgaagaatcgctgagagtaattggcaagaagacgacgtcggctttcaggcggactccaatcttgatcgtcatcggcgacccaacctgatgatcccaagtctctacagcatgctctggggaaggtagccatagaagtatgaagagtttccggataacctggtgaccctggagttcttctgggatgccaccgaaaggatggattggcaacagcatcggcca

SEQ ID NO: 86885 - protein, 68 aa, Zea mays
  misc_feature: Ceres CLONE 1573556
MSGAVVNCVYIPLNAETIAFLLEHSVAEVVMVHQECFTLAEESLRVIGKKTTSAFRRTPILIVIGDPT

SEQ ID NO: 86886 - DNA, 912 bp, Zea mays
  misc_feature: Ceres CLONE 1573557
  misc_feature: SWISSPROT Homolog: EC 5.3.1.1 Triose-phosphate isomerase
  misc_feature (525)..(525): n is a, c, t, g, unknown, or other
  misc_feature (533)..(533): n is a, c, t, g, unknown, or other
ctggagctccccgcggtggcggccgctctagaactagtggatcccccgggctgcaggaattcgtctcacccctagaaaaaaaagcagcgaaatccaatctagaagctcccctctccctccctccctctctctctctctcttcggcggccgaagctccgcaccccatctaatatcacaccccccccaaatgggccgcaagttcttcgtcggtggggacctggaaatgcatggaacacagatcacgtcgagaagattgtcaaaaccctgaatgaaagacaggttcccccttcagagttgtctaaggccttgtcagccctccttatgtctttccttctgtggtcagaagcagctgcgccaagagttccatgttgcttgctcaaactgcttggtgaggaaaaggaggtgctttcacctgggaaaaacagtgctaaaaaggtcgccaaaccatgggggttccccggggggatccttggaagaccttgaaaaggaagactccctcggggggaatcaaaacaatttttttgnggataggnaattgcctatgcccctgtccccagggactaaaggccattgcatttggtttgggggaaaccccttgaaccaaaagggagggtggggcctaaccaggggaatgttgtgtggtgggcccaaaacaaaagcaaattgttggaaaaaatacagggatggggaccccccttttttttgcccaataaaacccctttggggccttttggaaacggggaaaatttccccccccccttttaagggtttaaaaagaggcccccccccctgggggggttgggaaaaaaacaaacccccccccccggcggggggtgaaacactcgggaaaatcctttgggggggtttttttaaatcctggaaaaaaaaaaaaaaattctaccccccccctgt

SEQ ID NO: 86887 - DNA, 1197 bp, Zea mays
  misc_feature: Ceres CLONE 1573558
  misc_feature: SWISSPROT Homolog: EC 5.3.1.1 Triose-phosphate isomerase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (73)..(73): n is a, c, t, g, unknown, or other
nnnnnnnnnnaaatttttttacccttgtttttttgtgtcttgccgttcgttgtttccttctgttttttgttgngggcaaactggaactccccgcggtggcggccgctctagaactagtggatcccccgggctgcaggaattcgtctcacccctagaaaaaacatcagccaaatctaatctagaagctcccctctctcctccctccctctctctctctctcttcgccgtccgaagctccccacccaatctaatcgacacctcaccgagatgggccgcaagttcttcatcggtggcaactggaaatgcaatggaaccgcagatcaggtcgagaatattgtcaaaaccctgaatgaaaagacaggtttccccccttcaaaatgctttccgacaatccgtttggtcaagccctccatgatgccctccttcctgtggtccaaagccacctgccccaaaaagttccatggttctttcccaaaaatttcttgggtgaaagaaagggaagttccttttccctggttaaaccttccatccttaaaaattcctctccctaaccccgagagcgtgcccccccggggtcttacatttggaacacctttctgaaaaacgagaaaacccctctcctttggggcaacgatttcccaaattagaaattttttttctgggaaagagaataacaagtttatcctcctttaatttacccccccgggttcttccctccagggtgggtgaatcaaaatagaacgggggtccactcgcctgaacaacgaatggaaaacaactgcgcgggccagaactaagcgaaaacgactcctctctcttcctatcgccacatataagagctggaatgtaggtgctttctttgcagaggtctctatctagcacaccccgtgatggaaaaatcgctttggggatgtctgcgccctggctcgcctaacataaatgacaaagagttggtgggccgttgtttttattcctctcgaggaataggcgttattttcttccaggtgagagacagagagtgactcattcactgtactctgtctttgtcgtcaggttcgcaaactaacaataaaccatctcctatctgccggttccttttattttgtatcgattaaggatctccttaatcttattgtttcccccccactccccatcaatctcatataatcttcctggactagagaacgacgcccccag

SEQ ID NO: 86888 - DNA, 1164 bp, Zea mays
  misc_feature: Ceres CLONE 1573561
  misc_feature: Encodes the peptide sequence at SEQ ID NO. 86889
  misc_feature (52)..(52): n is a, c, t, g, unknown, or other
  misc_feature (72)..(72): n is a, c, t, g, unknown, or other
aacccccataaacaacaacccccacccgaccactggccccctccttatcggngaggaagaaataaactccanaaccaaaaatgggactcccgacggtggcggccgctctagaatagtggatcccccgggctgcaggaattcgtctcacccctagaaaaaaccggtccagcccacatctccacaaggacaccatccgcgacctgcaagcaggttcccctccccatcccggagagcaaaagcgcttctctcgctagcgagttcggcagtagaaaccctaaaaaaaaagacaccgccctctccttcgctagcggaaccgccctcccctcgccggggtaggggtttcgggggtagacgcccgccatggacgcgttccggaaacatctggacgtgctcatgggcgccacaccgcaacggcgacgtcgaggaggtgagccgcaactactacgaccgatacgtctgccgcctcttcctcgccggatcgtctgcccacacaagctctctcagctcacgaacatggatctcgggccttggactaagattcattctcggcaacctgcggaaacattactgaagaaagcgaaagtcaaaatgaaccagacaaattttcgattgaagaacctgcgaggtatatggatcagaaaagggcttcacttgatggcacctggcggacaagggaaaaaatttccagaaggagaggaccccttaataaacggcggctttggccaagaattggaattgaactggccccaaattgggccttggactaaatcttgggctggaatatatactctgcggtttacctgcttatggaaatgggtattaccactactgtgaaaccttgataatttgtacacaaaaaagccttggccatggccctcgaccccatcaaaaagccgaggaatttaacaagggggatgagaagaaaactggggctcatatcaaataatttctcaatgggacccctcttcttgagatttttattggaaaagggcggaggaaaaacctttaattggcacccatcgaattccaaaggcggccccaatgttaaaattttatttcgggaacaaaaatcctttaaaaaatcctctacaacacacagcctgtaatagttggtagaggaacaaaccccctcacttgaccttacgaaggacgcgtttcaaacaa

SEQ ID NO: 86889 - protein, 106 aa, Zea mays
  misc_feature: Ceres CLONE 1573561
MDLGPWTKIHSRQPAETLLKKAKVKMNQTNFRLKNLRGIWIRKGLHLMAPGGQGKKFPEGEDPLINGGFGQELELNWPQIGPWTKSWAGIYTLRFTCLWKWVLPLL

SEQ ID NO: 86890 - DNA, 794 bp, Zea mays
  misc_feature: Ceres CLONE 1573565
  misc_feature: Encodes the peptide sequence at SEQ ID NO. 86891
ggagctccccgcggtggcggccgctctagaactagtggatcccccgggctgcaggaattcgtctcacccctagaaaaaattcctcctagtcgacaaaccgcaccttatccctgttgacccgacggtggcgctcatctcctccccgacggtggcgctcatcttccccccgacaggtctccccatctacctgctggcttcccttcgtcttccccgacactgatcctcaccactcatgtctgctgaacttgccggaggaaacccttatttcctctcatgctacttctggttcatatactgcataaaattccgacatttcacttgatacaagtggaacactaggagttttgtgcggatacttcctaccatgtgaatcagttgtagctggtgaatttggcaagactcaagtcctctcatctgggttcagaaaacatctgtcggttgattgcttggtctcctgtttcatttgagtcttgccaaccaaagctttctctcagcatcagttgtggtctacgaactctttctgtgacttgaccaacatctcttttggtcctgtcaatcttgcaacactcccttccaaagacttgtctacaggctagattgccctgctctctactggcgctgcatcctcctttagtcttccaagttttctcttgagagcagttgtgatctacgaactctttctgtgacttgaccaacatctgatttgggcctgtgcatcttgcaacgctcccttctaaagacttgtctaaaggtttgcgattgccctgctcttctgctgggcactgcagccttcc

SEQ ID NO: 86891 - protein, 29 aa, Zea mays
  misc_feature: Ceres CLONE 1573565
MSAELAGGNPYFLSCYFWFIYCIKFRHFT

SEQ ID NO: 86892 - DNA, 822 bp, Zea mays
  misc_feature: Ceres CLONE 1573569
  misc_feature: Encodes the peptide sequence at SEQ ID NO. 86893
tccccgcggtggcggccgctctagaactagtggatcccccgggctgcaggaattcgtctcacccctagaaaaactccctccctgctttcgtttccccctgtcctaactcctaagtcctaaccaaccaacgtttgtatgaccgacatacagaccccaacagcgagagcaggctcacgctggtcgacggcgacgtctacgtgccgcgcgacgagcgcttcggccacatcaagaagtcggacttctacggctacaccatcaaggcgctggtgaacgccgtcatcccggcaatccgcacctacgtcgacctgtcgcccggcgagttcgactccttcaaggacatcatgaagctgtacgagggcgggatccagctgcccaaaataccagccctcgaggacctgcggaagcagttcccactcgagctcgtcaaggatgtcctcccggtcggcggcgactacctcctcaagctccccatgccgcagatcatcaaagaggacaagacaggttggatgacagatgaggagtttggacgggagattctcgccggcgtgaaccccttgctcgtcaagcgtctcacggagttccctccgaggagcagtcttgacccgagcaagtacggcgaccacaccagcatcaatcgggaagcggacctcgagaacaagctcgagggcctgaccgtgcagcaggcgctgcacggctaccggctgtacatccgtgaccaccacgacaacttcatgccgttcctggtcagggtgaacagcctgggagggcatcttcttctacgccaccaggaccggggctgtttcctgcatgggcaaagaaacc

SEQ ID NO: 86893 - protein, 160 aa, Zea mays
  misc_feature: Ceres CLONE 1573569
  misc_feature: SWISSPROT Homolog: EC 1.13.11.12 Lipoxygenase
MKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSINREADLENKLEGLTVQQALHGYRLYIRDHHDNFMPFLVRVNSLGGHLLLRHQDRGCFLHGQRN

SEQ ID NO: 86894 - DNA, 928 bp, Zea mays
  misc_feature: Ceres CLONE 1573572
  misc_feature (862)..(862): n is a, c, t, g, unknown, or other
tccccgcggtggcggccgctctagaactagtggatcccccgggctgcaggaattcgtctcacccctagaaaaagtctctctcatctcatccagcctgtgccaaaacaaaacgagaaaaaaaagtcttgctgctgctggtggtggagcgagaaaggaaaaaaaaaaagaaggggtaatctcaggaaccatctagatacagcggcggtacgtggactggactggagcgagcaagcctgcgccggcgccgccgtcctcccgaaacagaagctgtagttggtcaagaactggggatactgagttgaatatgatctcaaatccggtggactggtatagtttcagaccccgatagaattgggtagggatgcaagattggagggtgcgtgagttctaaaggtaattgccctggatgagttttccccacagcaagtaggcaccaacaataaagggggaagtttaaggccttctggggggccctttccccaagcaagaaagtttaaaaccctttggccgtttgcttaattgaggaaaaatccccagggggtgtccattcccccccgggaacacaaataaggctttccgggggttcccctttggaaaacacttataattttcaaaaagaaaacaatttcccccccaatgggcccaaaaaaggggggggttatcttttttccccccaaaaaaaaattaaaactcttgccccctttgttttccccctccccaaaaaaaagggggcccccccttttggccccttttttccttttttgggaaaaagaaaaaaaaaatttcccttttttccttgggggaaccccccaattttgtcctccaaaaataaaaaaaattgtgggaaataccccctcggggnaaattttttgcccaccaaaaaaacaaaaaggggggcctgcccccccttttttttaaaaaataaaac

SEQ ID NO: 86895 - DNA, 811 bp, Zea mays
  misc_feature: Ceres CLONE 1573573
tccccgcggtggcggccgctctagaactagtggatcccccgggctgcaggaattcgtctcacccctagaaaaactccctcctttgggcttgtctctgcctctctctctcctcccttctcccacccacccctctctcttgctgtgggtgtgctgtggagaggagaaaggaagtagagcaagaacaagaactaataacaccaacaagagctgctgccaactcctgcacagcctgggctctcatcactgattgcccacctattaccttcctcttttgcgatttaaaatcacccatatatctacctgctctcggtcctctgtgaactctctcgtcttctaggtttcccaggcctcaagataggcctctggaccaaagcttgaaagcagctgctgttcttgcctccttttttaattcttcatttcgtggttcctggatttttgggatcttaggtttcttgtatcttcccccaaccttgcaaaatcttgtggtgaagtttcttgcgttcgctgtttcgggaccatggacgaaaggattccgccgccgtccctcttgcaataatcgcagtcccctgctcattcgtccccccatccacacaattctatgaggtattcttcctctgaaagagacaagtgagtgttgttctagatattattattatttcctgtagacctattgttctcacagaagtgcaaggtgagttatgtttcgtttaagaatctgtcctttcggaatcctactgaggagcaccacatttgatgcttcggttggagattccccgttaataccaacctcccggaggcagtgttttccctc

SEQ ID NO: 86896 - DNA, 786 bp, Zea mays
  misc_feature: Ceres CLONE 1573574
ggagctcaccgcggtggcggccgctctagaactagtggatcccccgggctgcaggaattcgtctcacccctagaaaaatccctcctttgggcttgtctctgcctctctctctcctcccttctcccacccacccctctctcttgctgtgggtgtgctgtggagaggagaaagggagtagagcaagaacaagaactaataacaccaacaagagctgctgccaactcctgcacagcctgggctctcatcactgattgcccacctattaccttcctcttttgcgatttaagaatgcacgcatatatctacctgctctcggtcctctgtgaactcgctcgacttctaggttccccaggcctcaagataggcctctggaccaaagcttgaaagcagctgctgttcttgcctccttttttaattcttcatttcgtggttcctggatttttgggatcttaggcttcttgtatcttcccccaaccttgcaaaatcttgtggtgaagtttcttgagttcgctggttcgggaccatggacaaaaggattccgccgccttccctcttgcaataatcgcagtcacctgctcattcttccccccatcccctcaattctatgaggtattcttcctctgaaagagaaaggtgagtgttgttctagattttaattacatttcgtttgaccctatggctctaccagaagttcaaggcgagttttgttttgctttttgaatgctgcctttctggatcatttctgaggagcacgcacattagatgctgcccttgggagatttcagg

SEQ ID NO: 86897 - DNA, 958 bp, Zea mays
  misc_feature: Ceres CLONE 1573581
  misc_feature (719)..(719): n is a, c, t, g, unknown, or other
  misc_feature (805)..(805): n is a, c, t, g, unknown, or other
  misc_feature (901)..(901): n is a, c, t, g, unknown, or other
ggagctccccgcggtggcggccgctctagaactagtggatcccccgggctgcaggaattcgtctcacccctagaaaaaatcgcccgccgcacgtcacgacatgcccttctccctgctagtgctgccaccgctcccgctgaaaaagattattagtttttcatttctatttttaataatctgaacctgctttcctgcccggggttcctttcttccccctccccttggggaagaaaccaaacctttccctggggggaaaaattttttttttttcttttcccccaaaaaagggggggccccaaaaaatttttctaaaaaaaaatttttttttttttttttttttggggggggcccccccccccctgggattttaagaaaaaaaaaaaaaaaaaactaatttttttttttttttctcccccccccccccccaaaaaaaaaaaaaaaaaaaaagggggccgggccaacaccaaaaaacaaaatttttttttttttttttttcttttttgtggggggggagaaaaaacaacactccccccctcttcctctttcttatattaaaaaaaacaaaaaaaaccacacaaaaccccccgtcctgcccggccgtcgggggggggtggggtggtgttgcgtggtgttttttatttttaacaatgttgagagaaatgataataaacaaatacatacaacaataaacacaacgaccgcggaagagtgagataatntgtgtgggggtggggaggggcgggtcgacattgaggccgcgttgattccgcatactacccctctcctccattcctcatctgttttntcatcttcgtcaggttaaagtatgatggcggggtgaggggggcggggcgcgcggacgtggcaagagggacgactctcgtatgagtacttgaagtanaggcggccgctttctcgtctcacttctcgcgcgcgactgcgatgaggaggagagggg

SEQ ID NO: 86898 - DNA, 849 bp, Zea mays
  misc_feature: Ceres CLONE 1573585
  misc_feature: Encodes the peptide sequence at SEQ ID NO. 86899
ccccgcggtggcggccgctctagaactagtggatcccccgggctgcaggaattcgtctcacccctagaaaaaacggggtactgctacctcaacgagcatatctgctttttttttggtaaaagaatttgtttttgcaaagctagctcctacgctgccgccgccatgcaccgcttcgccgccgacagggcgcgccgcgcggtggccgcgtccctgcgcggcgcaacttccagagcagcagcagcgccgtcgcgtcacgctccggcgcctcgccatccaacctccccagtcggggcggcggcgcccgttgctgccgccgccatggcgagggccgccatgtccacagcggtcgcgggcctgccaccaccggtgtcgctcgacaccatcatccccaaggtgccgccaatgtcgctcgacaccatcaaccccaaggtcttgaagtgtcaattagcagtccggggagagattgtcacacgtgctcagaaattgcaacaagaactgcagagaaatccagaatcgcttccttttgatgagatactctgctgtaacaggggaaatccccataccatttggccaacagccagttacctacttcagagaagttctatctttgtgcgagaatcccgctctttctggacaaaagtgaaacgcatgctttctgcaggttgcatgctctagagagagcacggaaaattcctgacaagataccccggaagaacctcaggaaccttattaccccccgacgggggcaataaaaagtttaccttgaataaaaatctcttgcccggaaatttgattggcccgcagaaagggtttttcattgcaaggcggcaataataaacagcgcttcac

SEQ ID NO: 86899 - protein, 170 aa, Zea mays
  misc_feature: Ceres CLONE 1573585
  misc_feature: SWISSPROT Homolog: EC 2.6.1.2 Alanine transaminase
MHRFAADRARRAVAASLRGATSRAAAAPSRHAPAPRHPTSPVGAAAPVAAAAMARAAMSTAVAGLPPPVSLDTIIPKVPPMSLDTINPKVLKCQLAVRGEIVTRAQKLQQELQRNPESLPFDEILCCNRGNPHTIWPTASYLLQRSSIFVRESRSFWTKVKRMLSAGCML

SEQ ID NO: 86900 - DNA, 869 bp, Zea mays
  misc_feature: Ceres CLONE 1573586
tccccgcggtggcggccgctctagaactagtggatcccccgggctgcaggaattcgtctcacccctagaaaaactctctctcattccacagatttgcatctaccataatggtcaactgggggtaaacaagcttgaaaaatgctgacagtggcacaaattagcatagatcactttgtatttttcaaaaagcaacttgtctgtacacagggattttctactgtatgtaggcttaattgggtaggcttgctggtgagtatagtatttatactcccttcacattagctatgaaaactatcactgctaccaaattttggttgtggagcaatcagcaaccttacacaatactaattgcatctctcaactcctagagtcgaagatccatcgattttgtgcacaacgggtatacatcactcacttggtatttatcacctgaacgtgtgaacttcgctatcactctgtttgtttggaagacgaaggctgaacaaatttcaccgatggacggcaacttggtatagtatttagttctttcgtacaccctttccttgaatataaaattccctcgtaaggagatatacaatttatttccccaacgttagccaatcggtcagacagcagatttttactccaactgtagtcgaactgtacctggaatttcactcctcttgtggaagctcaacatgcgcaaggttcgcactcgcaactgagagagataccattaagcctacaggataagccttcctttgagtttgtgcacactgcacacccgaagaaattcataagatgccctataagccaaagcaagatggggaaaaaaaagcgggaccaatcagggagggggtatttatctttgaaaggttgaagacgaagag

SEQ ID NO: 86901 - DNA, 809 bp, Zea mays
  misc_feature: Ceres CLONE 1573588
ccccgcggtggcggccgctctagaactagtggatcccccgggctgcaggaattcgtctcacccctagaaaaactctctctcattccacagatttgcatctaccataatggtcaacggggggtaaactcgcttgaaaaatgatgagagtggcccaaattagcatagatcactctgcatttttacaaaaaggaggttgtctggagacaggcatattcgactgtatgcaggcttaattgggtaggtttgccgagggaccttcttatttacagtgatcgatagattcagtacgaaagctatcactgctaccaaattttcgttgtgcgaccaatctgaccccttacacaatactaattgcatctctcacctcgtaaagtcgaacatccatcccaatttgtgcataaggagtatacatcactcagcttggcattgatcaccttccggttaaccccggtatcactgtgcttgtttagaaaaggaaagctcaccaaacttcaccgattgagggcaacatgctatagtatttagttctatcgcacaccctttcgatgatataaaactccctgcaaaggagatatccaatttatgtcccaacgtaagccaatacgccagacaacgcttttcctccaactatgttgatctgtagtggatttcactcctcgcgtggaaactcaacatgtgcaaggtacgacttgtcactgagaaagatacagctatacctacaggtaatagcattcatcgaagctgctgcacacgcccctacggtaagaaatgcctaccagctaagcagaatgagactacaagtggacaaa

SEQ ID NO: 86902 - DNA, 845 bp, Zea mays
  misc_feature: Ceres CLONE 1573590
  misc_feature: Encodes the peptide sequence at SEQ ID NO. 86903
  misc_feature (659)..(659): n is a, c, t, g, unknown, or other
cgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgacagtggtcaagggcgacccggccgcgaagggcgaggccgccgcgcagggcgcgccatcgacgccgagggcgcaccagcagcaccgccaccccgccgcccccgccatcgccgtcagcgacagctccctcaagttcactcatgtgctcaacaacctctctgctgctgagctgttcgagcaggccctcaagtacgagaaggggtcgntcatcacgtccaccgggcgcgctgggcgacgctggtccggggccaagacccggggggggcctcccaggggacaaagcgcggttcttcaaggaaccaaggtcacccgccgcagggacccgggtggttggggggaaaaggggctcctccccaaccattcgaaaaattgggaccgaataataaaccttt

SEQ ID NO: 86903 - protein, 229 aa, Zea mays
  misc_feature: Ceres CLONE 1573590
  misc_feature: SWISSPROT Homolog: EC 4.1.1.49 Phosphoenolpyruvate carboxykinase (ATP)
  misc_feature (168)..(168): Xaa is any aa, unknown, or other
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPTVVKGDPAAKGEAAAQGAPSTPRAHQQHRHPAAPAIAVSDSSLKFTHVLNNLSAAELFEQALKYEKGSXITSTGRAGRRWSGAKTRGGPPRGQSAVLQGTKVTRRRDPGGWGEKGLLPNHSKNWDRIINL

SEQ ID NO: 86904 - DNA, 792 bp, Zea mays
  misc_feature: Ceres CLONE 1573591
  misc_feature (636)..(636): n is a, c, t, g, unknown, or other
tccccgcggtggcggccgctctagaactagtggatcccccgggctgcaggaattcgtctcacccctagaaaaaacgctctggtttatctcttcgcgtcggtgttgcttttcaagcgcctcgcctgtccctgtcttgccctttgcgccttcgtcaccgcgacgcgctttcgttttccaatccttccttgtcttatactccgtttcgacttcgagcagggtcgatttcttcttcggctgatctgttccgctgctgctgggcttccttgttctcgcagatctccatcgggcgttccgctttcgtgcgacgcggcgagcgagcctgtgttcggtggcggggttattgagtttgccgttcattttttcctgcaattcgtctagtcatcgtgtgcaattcgtctagtcatcgtgtcgatcttgtttcgtctcgcctcctcagcttgtgggttgcaggattggatccgatctggtatggggagttcgtcatgttcgcctgaactcggaggcaggtcagtattctgtcagatccaacggttcattggttgtcacttggacatggattcggtggtttcaggcccaatcatctcccggtggggtaccaccagaaattgtcacttggacatggatttgaagattcanggcttatcgtctccccggtgcggtagcatcagaaaccgataatgcagttatagcctgcacaccaggtgggatttgggagaaccttcggaaaattctttatgtaactgctgatctcgccttttggccttttggttggttgggcctcttaaaacttca

SEQ ID NO: 86905 - DNA, 819 bp, Zea mays
  misc_feature: Ceres CLONE 1573594
  misc_feature (781)..(781): n is a, c, t, g, unknown, or other
  misc_feature (819)..(819): n is a, c, t, g, unknown, or other
ccccgcggtggcggccgctctagaactagtggatcccccgggctgcaggaattcgtctcacccctagaaaaaatgctggtcggcggggcggaattcaggggtgcttgccagacgccggccccctcgggcattgcagacgctctctattgtatcttctccaatctccgggagcgcgcctgagatgaaatgacggctgcccgaagagctgccgccgggatcagggcctgtcgtgctacggcaccctgaactgggacttcctctatgggcgccgacccattatgacccgcgagctcatctccatgcgactctgctcctccgcctccaatttgacgcggcgccgtcgcgcgttacatgattggaccgcactctcacacggagatctttccgcatgagcagtacggaggcacttctcgctcagatagccccccaagctcaggatgttccgataaactcgcccccagtgtcccgcacttgctgccgccgtgggaaggcgacgtgccatctcatggagaatctgatgccgatgggccatctagaccagtttgtcgctgactcatgcttcgcctgaaacgcggcgcggctgtccagtttctacggcctctcccggagtacttggctatggaggcgtcggcgtccctggacagtttgttatcccggacgccggccccatcggcgcattgaaggagctggagctcgggaacggccaggacgagtcgtctgtgtgagatgctggcttacgtgagcacgtagatgggcgctcaacaacgggacttccggactntaatgcgaataatcgggaaagttaactggaagggcaan

SEQ ID NO: 86906 - DNA, 802 bp, Zea mays
  misc_feature: Ceres CLONE 1573595
  misc_feature: Translation starting site: 143
ggagctccccgcggtggcggccgctctagaatagtggatcccccgggctgcaggaattcgtctcacccctagaaaaaaagatataccgcggacgcgcggagaggtgacgaaggccagacgccgacgcccacggccatacaagatgatggagatcctcaccatcactattgatcaagccgggatccatgtccgcgacgactgctgggagctctactgcctacgagctggcctcgagcaccatggcaacatgcccagtgattcctctgttggcagtcgcactatgtactgccttgcaagccgttcttcaacgagactggatccgacactcatgtgcccagagacatcttctttgagcttgatcccactgtcatagagtacgttcgcactgggtaagtaccgacagctcttgctcccagagcatctcatctcaggtaaggaagatgcacctgacacactgtgcccgtggtcactacccgggaggaaaggagattgtccatctctgacaggaccgtgtgcacaagcttgcgcatcgactacactgtgctgcatgcatgtcttggatgacaatgctgctggtgacaatactgacatcggactggtgttacagctgtcggagcgccttgtcaaccatcctggcggctagtataagcttgcatacacacctcaatacttcggcagaggggtcagaagctgctgaagaagagtacatcagtgtcttcttgaccaccgccttggtgcagcacactaaatgttgaagtgctacgtggacaattaggctgaactctgacatatatcatcatgt

SEQ ID NO: 86907 - DNA, 937 bp, Zea mays
  misc_feature: Ceres CLONE 1573597
  misc_feature: Encodes the peptide sequence at SEQ ID NO. 86908
ggagctccccgcggtggcggccgctctagaactagtggatcccccgggctgcaggaattcgtctcacccctagaaaaaggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcggcgacgtccgcgtgggcgggcgcgtcccccccgaggagccggagccggaggtcttctccttcgccgagcccctcccgtcgtggcccacaggcgggggattcgcgcgggggaggatacgtatcggcggaggggagctggagctcgccgcggccaccgcgttccagaagatctgcaccctgtcgtccgggcgccgtgggcggcaatgagatcatccactttatgaccgggacgtggggcttccaggatagggtactactgcactaggagattaacggatacttgaaagtgtaacgctacttcaatggcccactgcctcatttgccacaatcctccgcaagcttttcggaagagggcttttcacttccatcaagaggacagaaagtcgaactctttggggcttggaacaaatttataccccccccccccggggaaatctaacaggcccgtctccgaggaatccccggtaaacggggtttccggtttgaaaatcgtatggccttgggctccgaggtaacccaatcaatgtttccccaggaaactccctaagaaaaaaccgaaggctggtgtgttgtgggaaaattatccccggggaacgcatcccgttaaacacaccctgcaaagaggcgagaagatttttttcactttggttttgagaggaatgggc

SEQ ID NO: 86908 - protein, 79 aa, Zea mays
  misc_feature: Ceres CLONE 1573597
MRRRWDSCFSGGDVRVGGRVPPEEPEPEVFSFAEPLPSWPTGGGFARGRIRIGGGELELAAATAFQKICTLSSGRRGRQ

SEQ ID NO: 86909 - DNA, 804 bp, Zea mays
  misc_feature: Ceres CLONE 1573600
  misc_feature: Encodes the peptide sequence at SEQ ID NO. 86910
  misc_feature (321)..(321): n is a, c, t, g, unknown, or other
tccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcgngcgataagaggggaggagagagaggcctagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaagccttcaccgtccgcaacatcagctccatggtcccaccctacgacaagatcaagtacgccggcacaaggtccgcaatcgagtacgccgtgtgcgcgctcaaagg

SEQ ID NO: 86910 - protein, 94 aa, Zea mays
  misc_feature: Ceres CLONE 1573600
  misc_feature (31)..(94): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACSDSRVCPSVTLGLQPGEAFTVRNISSMVPPYDKIKYAGTRSAIEYAVCALK

SEQ ID NO: 86911 - DNA, 893 bp, Zea mays
  misc_feature: Ceres CLONE 1573602
  misc_feature: SWISSPROT Homolog: EC 2.7.11.1 Non-specific serine/threonine protein kinase
  misc_feature (851)..(851): n is a, c, t, g, unknown, or other
  misc_feature (893)..(893): n is a, c, t, g, unknown, or other
ctccccgcggtggcggccgctctagaactagtggatcccccgggctgcaggaattcgtctcacccctagaaaaatagtttctgaccccgtgtggattattctctgtcactatcgaggcggggcgccaattgcggtggccaccaccttgaatccactccccgcggaggcctcgcccagctgttcttgctccgtcctccctccaactccaagatttgtttcgcacccgattcctgagcttccgcggcgcttcttgctgaaaagaaagctccgagttcttcacttctggatcgatagagaggcggttcctttgcgggctctgaggttcatctctcgctcttgatttgtctcatcgacacatcaattgggctgcaagcttagagctggaaggaataatttgactacagaaatggggcaggcgttgtagcatacctcccgccccggactctggaccgagaggcaccaaatggttatggctattctaaccaggcaaagccagctcaaacacctgctagatacaaccctcctcaacagcccgcccgaggtgagggacacgcccaccggaccacgaaccctccgggaaatcccacctgtgcctggtgcctggtcccagcgaagcccaccgcgggacaccaatttcttggccaaacctgacgaggaacctaagctcctgtccacccccccgtcgaaaaggaacttgggccaggggccagttccgggggtgacactaacctcttggcccaaaggggttttcctccccggaaaaaacttttcccccattgctaaatcccattttccaaggcggcgaagctttacccctccaaaggtggaaaagggggggagaacctttctcnggagaaagaataatcccgaatatttggtgcgactattctttn

SEQ ID NO: 86912 - DNA, 751 bp, Zea mays
  misc_feature: Ceres CLONE 1573603
  misc_feature: Encodes the peptide sequence at SEQ ID NO. 86913
  misc_feature (626)..(626): n is a, c, t, g, unknown, or other
  misc_feature (687)..(687): n is a, c, t, g, unknown, or other
ctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaaacacgcttttccattaattcaaagggggggattttggggattgaaccaaaatccccaaacctttttttaaaaaaaaaaccccgggtggaacacattttcccaagggggggggggggaaaaagaagttttttttgggaaaccctctttttttttggggggcggcccaaatgttccccccaaaaagtgggcgcccccccttcggggggggggggtttttttttttttttttattttgggggggccacccccccccccctttnaaaaaaaaaaaaaaaaaaaaatttgggtgtgtggccccccccccgcccccccccccccccncaccctgagaatataaaataggggggtggttgggggtgggtggtggttatgtgttggtggggtg

SEQ ID NO: 86913 - protein, 97 aa, Zea mays
  misc_feature: Ceres CLONE 1573603
MASETETFAFQAEINQLLSLIINTFYSNKEIFLRELISNSSDALDKIRFESLTDKSKLDAQPELFIHLVPDKATKHAFPLIQRGGFWGLNQNPQTFF

SEQ ID NO: 86914 - DNA, 907 bp, Zea mays
  misc_feature: Ceres CLONE 1573605
  misc_feature: Encodes the peptide sequence at SEQ ID NO. 86915
aagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgaacgggagctcgccgcgcgggtggcggaaggtccacgggagcaacaactggggagggtctgctggaaccccatcgacggcgtggttcttcaaggagttcattcgctaagggggaagtcgcccaggccaccctaagaaaggtttcgaataagaaccggtttttccccctaatgggggaagttgtgaagtacccggggaaaaaacttttttcccaaaaggtggggcttcgggggatttgggtaaaaagggaccccccttatcttttatacccccttggaaaagaaacttaagtttccccaaatttttggaataaaaaaaggggccccccccccccaaagagggaaaggggggggcggggcgatttttctgggggggatgtggggcgggttcccccccaaaaaaaaagaaagggggggggtttctatcccccgggag

SEQ ID NO: 86915 - protein, 116 aa, Zea mays
  misc_feature: Ceres CLONE 1573605
MAATVSSCLSLVPTVHHRAGGFPSSVALTNTLQRRRRSRRYLVVASATRAEQEAAPVTIEDVDLSSHQAAADERELAARVAEGPREQQLGRVCWNPIDGVVLQGVHSLRGKSPRPP

SEQ ID NO: 86916 - DNA, 2013 bp, Zea mays
  misc_feature: Ceres CLONE 1573606
  misc_feature: Encodes the peptide sequence at SEQ ID NO. 86917
ggccctccctcgtccccagcctcgccgtccggcgctgccctgtcccatctcaccgcagctcgctcccacctcgagccgcgagcgcgcccgtagcagtctcaacgcgggcactcgcttgcgtaccccaggccgatcgacgagtccgcccggcccgcgtctcacgcgtgagcctgttgcgcgcggtggcttgttgttcgatcatattcgtgtacgggcaccccgcacggccggagaatcacttgccagccccagccccgttttccggggctcctcatccctcgcctcgccggtacgtacggtgttgcttcccggaggtttccgctgccgctgcgtgccggtgccgcgggcaggcgcaggaggctctcggctgtttccttagcgtgccatcgtccatggaggcgaagcagcgcccgcggcacggcgaggagaggaggccgccggcgacggacaacggcggcggcggcggcggcggcgaggagtacgacccatggacggcgtggctctacaagccgcacaccatctcggtgctcctcgtcggcgcctgccttctcatctgggcaagtggagcactcgatcctgaaggcgctgctgctcacagtagcttgacatcaatcaagaggggtgtctgggctatgattgcagccttccttgcctactgcacgcttcaggcaccttcaacgatacttattaggccccatcctgctgtctggcgcctggtacatggactggctgtcgtttacctcgttgctcttaccttcctccttttccagaatcgtgacgatgctcgccagttcatgaaacaccttcaccctgatcttggagttgaattgccagagagatcttatggagctgattgccgtttgtatgttccagaaaaccctaaaaacaagttcataaatatttatgagacattgtttgatgaatttgttgttgcccatatccttgggtggtttggcaaagctgtgatgatacgaaatcaacttctactttgggtattgtcgatcggctttgagctaatggagctaacttttagacatatgttgccaaactttaatgagtgctggtgggatagcattattttggatatcttgatctgcaattggtttggtatttgggcaggaatgcacacagtccgttactttgatggcaaaacatatgaatgggtcggactgagccgccaacgaagcatcatgggtaaggtgaaaagatcgctgagccagttcacccctgctcaatgggacaaggatcagtggcatcctttcatggggccactgcggttcatccaagttctgttcctctgtgttgtcttcatgaccgtggagcttaacacattcttccttaagttttgcctgtggatccctccaaggaatcccttagtcgtgtacagattgatcctctggtggctgattgccatcccaaccatccgcgagtacaactcctacttacaagacagcaaaccggcgaagaaggttggagccttctgttggctctctctggctatatgcatagtggagctgcttatctgcatgaagtttgggcatgggctatttcatgacccaatgcctacctggctgatcatcttttggagcttggttgggattgcacttgtggttttcttgctttcatggtcatggaggagtcacagaagattcaggagaaaacggctgtgatagatttcaataactcaccttagattctttcaattcgcttcttttcttttctctttctctttctttttcatttttatatacgatatggtatgatatgatatgtgatgtaacctacgttttagaggagccccatttttctgctgctcctggcaggggactcggtttgtcaggataggtcattgttgtcaacatgagattgatgaataatcaaggtagctgcagcatcagcaccaagtgtaattaaacagtaaagcaagatcactgtgcgtgtattgggcttaccaaacttcttctgggccagtaatgcatagttgtgtaataccaccaaaaaaaaaaaaaaaaa

SEQ ID NO: 86917 - protein, 425 aa, Zea mays
  misc_feature: Ceres CLONE 1573606
  misc_feature (101)..(384): Pfam Name: PSS Pfam Description: Phosphatidyl serine synthase
MEAKQRPRHGEERRPPATDNGGGGGGGEEYDPWTAWLYKPHTISVLLVGACLLIWASGALDPEGAAAHSSLTSIKRGVWAMIAAFLAYCTLQAPSTILIRPHPAVWRLVHGLAVVYLVALTFLLFQNRDDARQFMKHLHPDLGVELPERSYGADCRLYVPENPKNKFINIYETLFDEFVVAHILGWFGKAVMIRNQLLLWVLSIGFELMELTFRHMLPNFNECWWDSIILDILICNWFGIWAGMHTVRYFDGKTYEWVGLSRQRSIMGKVKRSLSQFTPAQWDKDQWHPFMGPLRFIQVLFLCVVFMTVELNTFFLKFCLWIPPRNPLVVYRLILWWLIAIPTIREYNSYLQDSKPAKKVGAFCWLSLAICIVELLICMKFGHGLFHDPMPTWLIIFWSLVGIALVVFLLSWSWRSHRRFRRKRL

SEQ ID NO: 86918 - DNA, 865 bp, Zea mays
  misc_feature: Ceres CLONE 1573610
ccccgcggtggcggccgctctagaactagtggatcccccgggctgcaggaattcgtctcacccctagaaaaactctctctcattccacagatttgcatctaccataatggtcaactgggggtaaacaagcttgaaaaatgctgacagtggcacaaattagcatagatcactttgtatttttcaaaaagcagcttgtctgtagacagggattttctactgtatgtaggcttaattgggtaggcttgctggtgagtatagtatttatagttccttcagattagctatgaaagctatcactgctaccaaattttggttgtggagcaatcagcaaccttacacaatactaattgcatctctcaactcctagagtcgaagatccatcgattttgtgcataaggggtatacatcactcacttggtatttatcacctttctgttaacttcgttatcattctgtttgtttggaaaacgaaggctgaacaaatttcaccgatggagggcaacttggtatagtatttagttctatcgtacaccctttcctttaatataaaattccctggtaaggggatatccaatttatttcccaacgtatgccaatcggccagacagcgctttttcctccaactggtgttgatctgggctggaattcactccctcgggtgggaacctcctacattgtggccaaggtttcgccttggaaactggagaaaaaataccaaggtaaaacccaagaaggaatatgccatttcatttggagttatgtggcaccacaccgaaaaaacatgaaaaaaaaaggccctatcaaagcccaagccaaaatgtgggaaaaaaaaaaggggggacacaaccaggggaagggggttttt

SEQ ID NO: 86919 - DNA, 802 bp, Zea mays
  misc_feature: Ceres CLONE 1573613
  misc_feature: Translation starting site: 152
ccccgcggtggcggccgctctagaactagtggatcccccgggctgcaggaattcgtctcacccctagaaaaactcaacctccgccatcaccgatgctgactcccacatgggccgccgcgcgagacccggcaccatctctgcacgagctgacatgggggatgcgtgtctctcaacacagctaattgatggagatgggggcttcaacgtctctggaatggagaacttcctgaatgatggccaggattgcgtggaatgctggctctcctatgctgctgtatcatataatgggcccgcaaactagggggacaaatacactttagaatcgtctttttggccccaattttaaggagatgcacgccttcacacgaagggctcaaacatacctcggtatatggttagcggaggcccagaatattagaaccgtgctcccctgcaatggatttgcaacgaactcatggagcggagaggggagaggatgactcaccattttagacgcatagagggttgtttgctatggcattttcacacattgtgctcactaatatgtggtgtcatgacctcggcagagagacagctgcatacaagccccctttcgaagactgtttgcccagacaagattatgtcgcccagtccttggaaaacaacattgattgcatgccatccgtgacaaactcaagacaccccatagaagatcttgacactgttttaggggcagacattcccaagatatggggaatctagttccaaaaccccatgccccaatgacgtaactacatgctaggcgaagtttattccgatgggc

SEQ ID NO: 86920 - DNA, 1208 bp, Zea mays
  misc_feature: Ceres CLONE 1573614
  misc_feature: Encodes the peptide sequence at SEQ ID NO. 86921
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (69)..(69): n is a, c, t, g, unknown, or other
  misc_feature (91)..(91): n is a, c, t, g, unknown, or other
  misc_feature (976)..(976): n is a, c, t, g, unknown, or other
  misc_feature (1043)..(1043): n is a, c, t, g, unknown, or other
aatataaataannngnggttttgactcccctcctcctacaacttatacaagccgcccaaacccacttanttttaaaagctggagctccccncggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcagtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgtagctgggcaccctcagccgcaacaagctgtggcgcaagggtgtgggaggggaggaccacctaacgaccctcccctaccggtgctacgccattcccctccacccgtacctccgccctttcaacccattcatcccgacccaaccatacaatggtcccaggggccccccaggaccccggttgcttaacccatccaattcgtaaccgtttccggccaaaggcccttatcaaaccgcccccggggctcctgaaacctccaagccccttcccaagggggagggggtgtccccacaacaagggggggcgccgaggaaaagttatttcccacaatcccgggaaacaccccttgttgtgctctcgccccgccccaaaaggttattcccccgcgggcataaaatggattttttcccgcaacactgaaagggagacaccaaaaccctccgtgtggggcccggtttatccgccatgctttccggcncgcgatatcttggcaccctgtgagccccaacaaagagtttcctcctgggagaaaatgatcgtagttnagaaaccgcaagagcccccggtttacaccttgtgcccacgagggtcagttgccaattggtgttttccgaagagacaccccaagacaaaccacaaagatctgcgccgccctcaccacctatggaaacacgaaagtggtttccaagcaccccaaagagggattttcc

SEQ ID NO: 86921 - protein, 137 aa, Zea mays
  misc_feature: Ceres CLONE 1573614
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAVAGHPQPQQAVAQGCGRGGPPNDPPLPVLRHSPPPVPPPFQPIHPDPTIQWSQGPPRTPVA

SEQ ID NO: 86922 - DNA, 865 bp, Zea mays
  misc_feature: Ceres CLONE 1573616
ctcaccgcggtggcggccgctctagaactagtggatcccccgggctgcaggaattcgtctcacccctagaaaaaagaagggaacaggcgcaccacgggactgggggagagagagagaggaagaaaaaaaaaaaaagcagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcacgcgtagcggcgtaggtaccatcatcatccatccccgcgacgacccaccacccacccctgcagtctgcagcatccccttccccactcccggctggtctgctgcggccacacctgcgccgatccacctccgctgcttcctgcctcaatatattcgcccgcctcgtcgcctccgaccccgccacagaaaggctttcagaaaccttcgaacccctaacctacggctcccgaccccgtccaattctcctcctcccaggggccggccggacttccaatgggccgttcctcaaaggcccgccccacacctaaaaaaactccggagggggcccgatttctataaaataaccccccctgggcaccctgggctcctttggaaattttgggcctcccaactcccctggtgaaacacccacaaaatatccccgggaaaattcgtgaaaagagaaaccaggtgttttatcaaat

SEQ ID NO: 86923 - DNA, 1039 bp, Zea mays
  misc_feature: Ceres CLONE 1573617
  misc_feature: Encodes the peptide sequence at SEQ ID NO. 86924
  misc_feature (1)..(1): n is a, c, t, g, unknown, or other
  misc_feature (55)..(55): n is a, c, t, g, unknown, or other
ntttttttgttttttgttgttattatctatttggattggggttgttttctttcanacccgcattgcccctaaattaattaatggggctccccgcggtggcggccgctctagaactagtggatcccccgggctgcaggaattcgtctcacccctagaaaaaacctcgcattcggccaccgaccggagccgggcatgtattcagccaaccactggggcggctcgttcgagatcaccgatggggcggcggacgataaccacagccgccacatggacctggaccgcagggcgctgtaggcgcggcagcaccactagctggacgagacgcaacagaactggctgctacgccctccggaggccaagaagaacgacaagtcacctggacctcgggtgtgtcctcatcaagcgcaagctcctctggtgcgccttgtggcgcgtcaccgccgctttcgtcctgatcggcctccccatcatcatcgccaagtcaatcccgcacaagaagccaggcccgccgccgccatatcagtacacagaggcgctgcacaaggcgctcctcttcttcaacgcccagaaatctggccaccttcccaagaacgatggcatcagagtggcacggggaactcttgggctggttagacaggctcctgacgcgcaagggacttcaaagggtggtcctccttccggacagcttactacctaaccgctagccgtaccaacaatccaaggtttcccaccttcccccgaatgggccctttccaccccatggaacgccctgccttaaagcctgggtcctggcgcaatccaaaagtacccggccgcccagaggtgccaaaggggcccttggggggggaggatattgtacccatgggccccagggtaagctctaatctaaggtggggggggtcccccggacctattccgggccaaactctaagccctatcaaaaatccccttgtgtgatttccacacctattggaacaaatagtagtaaccctcccccccagatttgaggatgcgcccgcccaaaagaataacaaagcgg

SEQ ID NO: 86924 - protein, 153 aa, Zea mays
  misc_feature: Ceres CLONE 1573617
  misc_feature: SWISSPROT Homolog: EC 3.2.1.4 Cellulase
MGRRTITTAATWTWTAGRCRRGSTTSWTRRNRTGCYALRRPRRTTSHLDLGCVLIKRKLLWCALWRVTAAFVLIGLPIIIAKSIPHKKPGPPPPYQYTEALHKALLFFNAQKSGHLPKNDGIRVARGTLGLVRQAPDAQGTSKGGPPSGQLTT

SEQ ID NO: 86925 - DNA, 815 bp, Zea mays
  misc_feature: Ceres CLONE 1573621
  misc_feature: Encodes the peptide sequence at SEQ ID NO. 86926
ctccccgcggtggcggccgctctagaactagtggatcccccgggctgcaggaattcgtctcacccctagaaaaaaaaagaaaccgccgcgcgcggagagggaggaagggcacgactcagactcctaccggctaacaagatgagggagatcatcagcatccacatctgacagaccgggatccatgtcggcaacgcctgttgggagctctactgcctccagcacggcatcgagcacgatggcaccatgaccactgattcctcggtatggtcgtcgcacatgatgccttcaacaccttcatcagcgagactggttccggcaaacatgtgcccggaggcaacttcgtcaaccttgagcccactgtcatccactagatacggactggctcgtaccggcagctcttccacccacagcagctcatctctgggaacgaggatgcagctaacaactttgcccgtggccactacacggatgggaaagagattgtcgatctatgcctggaccgtgtgctcaagcttgcagacaactgcactgagctgcagggattcttggtgtacatgcatgtggatgctggtactggctctggacttggttcactgctgatggagcggctttccgttgatatgacaagaagtctaagcttggttggaactttatccttccccacaggtgtcaacaactgttgaagaagccaatcaagatgtcccctccaccccttcctggcccgaggaaacttgatgttacaaccttcctggacaaggaggctatcttggaatatggcggaaggtcccttggcaattgaaaggaaaacctgtcct

SEQ ID NO: 86926 - protein, 35 aa, Zea mays
  misc_feature: Ceres CLONE 1573621
MVVAHDAFNTFISETGSGKHVPGGNFVNLEPTVIH

SEQ ID NO: 86927 - DNA, 781 bp, Zea mays
  misc_feature: Ceres CLONE 1573625
  misc_feature: Encodes the peptide sequence at SEQ ID NO. 86928
tggagctccccgcggtggcggccgctctagaactagtggatcccccgggctgcaggaattcgtctcacccctagaaaaaggcaggcagacgcagcaccaacaacaacctcctcctcctcctaagaatctctcatctgagatacagacagattaatcaacgcccgcacctcctatgggcacgaccggcgacgctccggctccggcgggggatccgcaggaccgccaccgtacccaccccccggcgacgaagcagcggacgacgctggtgttcacgtacaggacgctgaaccgcggcttctccaaccaccgcctcctggaggagctcttcgcgagcggggacgcgtcgctggtgggccccgcggtgacgtcggcgcggctgccgctggtgtgcgggccgtaccgggtgccgttccttctgaacctccccggcgccggcgccggggcgcaccgcgtgcgcggggaggcgtacgcggtgacggcccgcgggcttgcgcggctggacgagctggagggcgtggagacggggcactacgagcggctggccgtggccgtggacctcgagggcggcggcgcggtggatgcgatcgcctacttcgcgcaccggagctacgccaacgacatgtggcggcgcagcggggagaagggcgtccccgagtacactcacggcgtggcggccgggtatgtccggcgcaaggaccggccgcatgggcagacgttcctggagcagatccggatcttcaattcgtctcctcccaatccgcttaataatccctcctagctt

SEQ ID NO: 86928 - protein, 201 aa, Zea mays
  misc_feature: Ceres CLONE 1573625
  misc_feature (32)..(143): Pfam Name: AIG2 Pfam Description: AIG2-like family
MGTTGDAPAPAGDPQDRHRTHPPATKQRTTLVFTYRTLNRGFSNHRLLEELFASGDASLVGPAVTSARLPLVCGPYRVPFLLNLPGAGAGAHRVRGEAYAVTARGLARLDELEGVETGHYERLAVAVDLEGGGAVDAIAYFAHRSYANDMWRRSGEKGVPEYTHGVAAGYVRRKDRPHGQTFLEQIRIFNSSPPNPLNNPS

SEQ ID NO: 86929 - DNA, 816 bp, Zea mays
  misc_feature: Ceres CLONE 1573629
  misc_feature: Encodes the peptide sequence at SEQ ID NO. 86930
ggagctcaccgcggtggcggccgctctagaactagtggatcccccgggctgcaggaattcgtctcacccctagaaaaactcaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctggaatgtatggcagtgtaagccaacttggaacagggaatgctatcctcattatacttcagcttttctttgctggcatcattgtcatctgtctggatgaacttctccagaaagggtatggcttgggatctggcatttctctgttcactgctacaatatctgcgagatatcatctggaaggcatttagcccacaaccatcacagtggtcgtggt

SEQ ID NO: 86930 - protein, 198 aa, Zea mays
  misc_feature: Ceres CLONE 1573629
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFTATISARYHLEGI

SEQ ID NO: 86931 - DNA, 809 bp, Zea mays
  misc_feature: Ceres CLONE 1573637
  misc_feature: Encodes the peptide sequence at SEQ ID NO. 86932
ggagctccccgcggtggcggccgctctagaactagtggatcccccgggctgcaggaattcgtctcacccctagaaaaaaagcaagccttcatcgatcgagtcgcccgtcaccacagctgatgttgaggcgacgcgccagacgtccgaatctgctcaccaagaataaacagaaaccggagccatgtcgcgactcctcgacctctgggccaccttgctgatggtcaggtccgcccccaccgtgaaggagtgggtgtccgcgacgctcacggacaggcgatacctgtagcaggtgcaacaacctgccctggctgaaagccatgcctgacctgcgacttaccacccgaaagaacgacaccgaggacctcgggtcccgcacgccgacagatgccagcggctgggactcctggggcatcgtgcacaacagcggtggtggcgtggtcggcgccaatgaccatggtggcctgaccctaccatgatggggtcggctcgccgttcatcacaggcttttggtgtgacgtactcccatatggtctccgcgaagcgcctcagaggaccatatttgatgccaacatcaaactctggagatagtgtccgcattaagaattccgtagcggactacgatggttgtcccatgcagaattatgaagactacagggtccgagcattcattacgagcaacctcaaggaactgggaagaccatggtccttaacccttatgacaactcgtgaacgttagtgcttgagacagatcacagaaggctgccctaaggcgggtttttggtcaaagaagatcagtggtaggcgcgctg

SEQ ID NO: 86932 - protein, 52 aa, Zea mays
  misc_feature: Ceres CLONE 1573637
MPDLRLTTRKNDTEDLGSRTPTDASGWDSWGIVHNSGGGVVGANDHGGLTLP

SEQ ID NO: 86933 - DNA, 1226 bp, Zea mays
  misc_feature: Ceres CLONE 1573638
  misc_feature: Encodes the peptide sequence at SEQ ID NO. 86934
  misc_feature (46)..(46): n is a, c, t, g, unknown, or other
  misc_feature (865)..(865): n is a, c, t, g, unknown, or other
  misc_feature (969)..(969): n is a, c, t, g, unknown, or other
  misc_feature (1122)..(1122): n is a, c, t, g, unknown, or other
gataaaaaataaaaaaatcctcctcctccgtccttctccatccccnacaaaccaaccagatcgtattataagctggaactcaccgcggtggcggccgctctacaactagtggatcccccgggctgcatgaattcgtctcacccctagaaaaaaccggaccccagcttggccagctacctcgtctcgcgcctttaccagctagcctacctacacacagcgtgtgcctgacggctgacgatgccgggtgccggccgcgccattatttgtctatatataagctaagcaatcgttcacaagtagcttctctcatcttgagaaagaactcctcgtcctcgctccctccccaaccatcaagagcgcacacgcacacgcacacgccgcgcgcaagccggccgacgtacggcatggagaagagcgctacaactggtggcggcggttcaagcggcggcggagaggcggcggatgaggcgaaggcgcctctgctgcagccgagggctgcggcggccgcggcggccgaggaaggaccatggaggaggaggaggatacgacggcaaagcgggcttccgcgggcgccgaatgaagagggcaagggacgcgttagaggatcagtcgcctgccgcctgactgccggcccccccgttggggaaggaagaaccaagaaaacactgtgggttttgtcggggccgggataccattccaatctttttcaacggggtccctgttcggcgatatccgtataacaggtacagatcaccaccgattacaatattctacgacctaagaaggcctttattttcaaatttcacgggtgcccaacaacacaactcgggaggtgggctccacatatgccgagagagtcttatcnggtcgcacccctcgtttaaactgagcggcccatttcgcaaatatattctccacaaccccaatttcccctctcctgtatgggagcggcgcttctctatactaaanatagcgaataccataatccccccgttgatctagggggggaccaatgtggaccgaaaaaagcacgtccgcaccatcggggaataaacccctctctgttttgtggctggtggcctacgaactgcgagatcaacatggcgagctcgaaaacagcancaaataacatccctatacatatgtgtgcccggcgggggaataatcatgacacacttagacagcacatagaatatgtatggggataaatactactcaccaaggaa

SEQ ID NO: 86934 - protein, 111 aa, Zea mays
  misc_feature: Ceres CLONE 1573638
MEKSATTGGGGSSGGGEAADEAKAPLLQPRAAAAAAAEEGPWRRRRIRRQSGLPRAPNEEGKGRVRGSVACRLTAGPPVGEGRTKKTLWVLSGPGYHSNLFQRGPCSAISV

SEQ ID NO: 86935 - DNA, 848 bp, Zea mays
  misc_feature: Ceres CLONE 1573639
  misc_feature: Encodes the peptide sequence at SEQ ID NO. 86936
ccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaacctgggcctgcagcccgggcgagggccttcaccgtcggcaaaatcgccctccatggtcccacccctacaacaaaatcaagtaccgcccgcacaggggtccgcccatcaaaaaaccccgggtgcccgcctcaaaggggcaagggtcatcgtgggtccattgggccacaagctgt

SEQ ID NO: 86936 - protein, 158 aa, Zea mays
  misc_feature: Ceres CLONE 1573639
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVNLGLQPGRGPSPSAKSPSMVPPLQQNQVPPAQGSAHQKTPGARLKGARVIVGPLGHKL

SEQ ID NO: 86937 - DNA, 1211 bp, Zea mays
  misc_feature: Ceres CLONE 1573640
  misc_feature (15)..(15): n is a, c, t, g, unknown, or other
  misc_feature (67)..(67): n is a, c, t, g, unknown, or other
  misc_feature (764)..(764): n is a, c, t, g, unknown, or other
  misc_feature (1125)..(1125): n is a, c, t, g, unknown, or other
cttctgggatatttntgtatttatttccacatcccaccaaaaaattcgaccgccccctctcctttgnaaataaaacctcccacacctggagctccccgcggtggcggccgctctagaactagtggatcccccgggctgcaggaattcgtctcacccctagaaaaaacaatctatcgatcaccaccaggtcctcctcatttccacgactcccgagcgcgttctcctcctgcgtgtcgcggtagcgtggcgactgcgaacgggagcaccaaggggagcatccgacgtgcccagcgtgggaggccaggttcaccaacgctcttcttcaataggcaagttcctcgaaggccggtctccgtgcaaaacgtaccgaaacctggaggcccctcggccccgggcgaagttgatcggctacccctcgcggggaggcaggcaagggccggagggcccaacattggccgtccaaagccgcccccgggtgaggcctttacgaacaaccggggccccttgttccccagggaaaaatggggaaccccccaaacggggggtgtgcaaagccccccccccaggggtcccggaaaacctcttaaaacaaaaaaagcccccccgtagaaatgaaatttttggccctcacttcttgaaacaaccgctggggaaaaacccccgcgggaagatcctttttctccccccacttgttaacctaataaactggtggaggggtaacacactcccggggtggacgcctccagcgaacactttttggtggnatggagacctaattatatacaaccccccccgagtggatgacccctcacacaaaaaaagagtgggtggtttacttcgtggatcgatctagaaataccctttctgaatacaactatttggggcgaagcgcgcggtaaaagacaacactcgatgccgcatgttataatcacctcatttaatgatgggagaggaccccctttactctccgctactctgtgaatgggggtctccaacaacaataccgttcagcgctctctttgataaaaaaacattaaccccgccgatggaggtgaagaagggtagtcgccatcattgttgaatgacagcgagaggggaggggggggggcgtccgggggtgagctnaacctctctacacaagggaggtgaggaaccaatgaatatcaccctacgcatgtgtggtgtgagcgaaccagcccctccgcctctgg

SEQ ID NO: 86938 - DNA, 820 bp, Zea mays
  misc_feature: Ceres CLONE 1573641
  misc_feature: Encodes the peptide sequence at SEQ ID NO. 86939
  misc_feature (777)..(777): n is a, c, t, g, unknown, or other
ggagctccccgcggtggcggccgctctagaactagtggatcccccgggctgcaggaattcgtctcacccctagaaaaagacacaatccattattccttccccttcgtttcgtttattccccacttccacacggccacaccgccacagccgccgccgccggacggcgctctccttccctgggaggcgctccactaggctcggctcagctcacgcgcggcggcggtgtccgtggctgctgggcttgcgcgcgcacctgattccgtgctgggcttcgcgaggtgctcctcgtgcgagacacacgcccgatgcggcggaatcgcgcggccggcgcccgagacccggcgtgattcggtggggaggctgggtcgcggtgcttccgcgtgcgggaaccagtgacttttttattcttctcttccccagcggctcgggcggctagagggcgggccgcttggtgctcgtcagcgcgtgaggcggagattacccggcgccgatctggtgctcttgccgcccggagaggtggtgccgggggccattgccgggttctgattaggaggaggcggaggaggtaagtccctagtcttatggggctcgcgccgccggagctggggcagttcgacgggtgggagagctccggggaacgagagggagcactggggctggtgccaccgcagccgccgcggcagcattaggcgccgcgcggaccccaagggcgccgacgacgacaccgtcgtctacaccggttgatgcatccgcctctggcccgtcggatcatgcccnccggacaccgcagcgcccgctccccaggttcaaagttcaaaac

SEQ ID NO: 86939 - protein, 35 aa, Zea mays
  misc_feature: Ceres CLONE 1573641
MGLAPPELGQFDGWESSGEREGALGLVPPQPPRQH

SEQ ID NO: 86940 - DNA, 836 bp, Zea mays
  misc_feature: Ceres CLONE 1573647
  misc_feature: Encodes the peptide sequence at SEQ ID NO. 86941
tccccgcggtggcggccgctctagaactagtggatcccccgggctgcaggaattcgtctcacccctagaaaaactccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgcccccgccgtacggagcttgcagccgggggcggagaacctgcaggtgcaggactacaaggacgctaacatgtattatggtgcttacccggcttatgcctatggagcctatggtggctggggggagtacccatacctgagccatgatggagcacagacaccaactgctggtacctatgctgacatgtactatggctatgctccataaggtgttgcaaccatggggcatgatggtcaaatttatggggcacaaaaattaccagtacccgtcgaccttcaccaagccaacgaaactctactggcaaagctggccatccaattggtgataagtgaagaaaattgaactccaggcgcccgcaaaacggatggtatcctactaattgggtgtcggaatgagggggaaaagggttcggaaaaaaattccaaatttcgcggggcagg

SEQ ID NO: 86941 - protein, 123 aa, Zea mays
  misc_feature: Ceres CLONE 1573647
MAAVGSLKPGMETLHVQDYKDAPPAKAAVESLQPAMESLHVQDYKDAPPAKGVAAAPAVRSLQPGAENLQVQDYKDANMYYGAYPAYAYGAYGGWGEYPYLSHDGAQTPTAGTYADMYYGYAP

SEQ ID NO: 86942 - DNA, 929 bp, Zea mays
  misc_feature: Ceres CLONE 1573650
  misc_feature: Encodes the peptide sequence at SEQ ID NO. 86943
acccgcggtggcggccgctctagaactagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccggggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacgggggagctcgccccccggttgccgggaagtccaacggcaacaacaactgggaaagggtctgctggaaccccattgacgggggtggctcctccaggaacctcattccgctaacgggaaaattcgcccagggcccccaaaaaaaagctttaaaataagaaccggtttttccccccctaactgggggaagtttaaaaaatcccggggaaaaaaacttttttcccaaaaaatcgggccttggggggatatctggtaaaaaagggaaccccgtatctctctatcgcccccttggaaaagcacccaaagttctccaccaattttgggtaaaaaagacgggcgcccacccccccaaaatgtgtgggggaggggtggcgggcgaatttactggggagagaggggggggttttcacccaacaaaaagaaaaaaggggggcgtttctctccccgaggaagaaaatacgcggggggg

SEQ ID NO: 86943 - protein, 38 aa, Zea mays
  misc_feature: Ceres CLONE 1573650
MCGGGVAGEFTGERGGGFHPTKRKKGGVSLPEEENTRG

SEQ ID NO: 86944 - DNA, 1185 bp, Zea mays
  misc_feature: Ceres CLONE 1573651
  misc_feature: Encodes the peptide sequence at SEQ ID NO. 86945
  misc_feature (21)..(21): n is a, c, t, g, unknown, or other
  misc_feature (38)..(38): n is a, c, t, g, unknown, or other
  misc_feature (846)..(846): n is a, c, t, g, unknown, or other
  misc_feature (898)..(898): n is a, c, t, g, unknown, or other
  misc_feature (1021)..(1021): n is a, c, t, g, unknown, or other
  misc_feature (1185)..(1185): n is a, c, t, g, unknown, or other
aaaaaataaaagaaaaaaaantcctcttacttcgaaangctgcacaaacagagacgcccttatataaaaaaaaaaaacggagctccaccgcggtggcggccgctctagaactagtggatcccccgggctgcaggaattcgtctcacccctagaaaaaacaccgcttcactcgtttccttccgatccatacacaccgcgcacgtacgcgtactccatcgtcccggtgcaggcgggttcacgtacgagctcgatcggccgagacgagatggcgacgccgaacgggcttgctcggatcgagacgaacggggcgacgaagcccgacaacggcgtgtgccacgacgacagctcggcgccggtgcgcgcgcagaccatcgacgagctgcactcgctgcagcggaagcggtcggcgccaaccacgcccatcaaggacggcgccgcctcgaccttcgccgccgcgctctccgaggaggagcgccacaggcagcagctgcagtccatcagcgcgtcgttggcgtctctgacacgtgaaaccggggccgaaaggggtcaagggtcgacccggccccggaggggccgaggcccccccgcgacggggggcaccggcccaacgcccccagggggcacccaccatggaacaaaccaaccccgggcggccccccaacaaattgccccgtttcaaccgaaacagggtttccccttcaaaatttccaaccccaatgggttcctctctaaaaaaaaccctcccttgtgcccccggggcgtttaaagcttttgttatacccaaaaaaacgtgggggcccctctctctcataatgtttataccacgaaaagagagggggggggggngtgcgttatttataaatataaaggcaagttcatgagaccggagggggggggnggctgtgggggaagaacacctttatgttttccttgtgtcgcctccatatataaaaccaggggggggcgggcccaccctccgccggagatataaaaaaggacggcttctcttaatatgagagcntaagagtggtcttatgcgtcgtgggaggtgaaaaccctgtggggcggcgggggagacgagggtggctcttagatcacaaccaagcagatgtgggaaaatagagagaccgttgttttgtcgcccaacagtattgaaaagacgccccctataaaagacacccctan

SEQ ID NO: 86945 - protein, 166 aa, Zea mays
  misc_feature: Ceres CLONE 1573651
  misc_feature: SWISSPROT Homolog: EC 4.1.1.49 Phosphoenolpyruvate carboxykinase (ATP)
MATPNGLARIETNGATKPDNGVCHDDSSAPVRAQTIDELHSLQRKRSAPTTPIKDGAASTFAAALSEEERHRQQLQSISASLASLTRETGAERGQGSTRPRRGRGPPATGGTGPTPPGGTHHGTNQPRAAPQQIAPFQPKQGFPFKISNPNGFLSKKNPPLCPRGV

SEQ ID NO: 86946 - DNA, 935 bp, Zea mays
  misc_feature: Ceres CLONE 1573652
  misc_feature: Encodes the peptide sequence at SEQ ID NO. 86947
gcggtggcggccgctctagaactagtggatcccccgggctgcaggaattcgtctcacccctagaaaaaatcagagagaaaaaaaactagatttagcgagggcggaccgacgacgcagtagaagcaaccgagacatggagcggcggaggaaggcaatgtggctgtaccccaaggtggtcggtttcaacccgccggagaggtggggccactccgcctgcttcttcgaaggcttcgtctacgtcttcgggggatgctgcggcggcctgcacttcggcgacgtgctgaagctgaacgtggagaccatggcgtggagtcttgtggccacgacggggcagtgcccgggcacgcgggacagccacggcgccgcgctggtgggccaccggatgctcgtcttcgggggcaccaacggcggcaggaaggtgaacgacctgcacgtgctggacctgcgcaccggggagtggacgcgccccccagtgcaagggcgcgaccgccgcccgtcgccgcggggagagccacaccggtcaccgctcgtcctgggggcgacccgccctccttcttctttctgccggcaacaaggggaaggccgaaggacaaacttccctcttgcggaacttgcccccatgccttggaaacgtgccccccccaatgaacgtgggtccctccccccccaaaggtttaagggggccgggccaacgttcgccccgtcgtcccctggggaaaggacccccaagtgtcccttgggccccttcgggcccccaagggctcttttcaatctttaggcggggggacatgcgtggggacccctggttcccccgtggcaaacatgtgaaacattgcttcccaactttaaaaaaccactgtgggggtgggcaaatgttttctcccggagaaaagggggcaaatttcccctcgggtgtttaaaaaataggtctatgg

SEQ ID NO: 86947 - protein, 214 aa, Zea mays
  misc_feature: Ceres CLONE 1573652
  misc_feature (21)..(66): Pfam Name: Kelch_1 Pfam Description: Kelch motif
  misc_feature (71)..(116): Pfam Name: Kelch_1 Pfam Description: Kelch motif
  misc_feature: SWISSPROT Homolog: EC 3.1.3.16 Phosphoprotein phosphatase
MERRRKAMWLYPKVVGFNPPERWGHSACFFEGFVYVFGGCCGGLHFGDVLKLNVETMAWSLVATTGQCPGTRDSHGAALVGHRMLVFGGTNGGRKVNDLHVLDLRTGEWTRPPVQGRDRRPSPRGEPHRSPLVLGATRPPSSFCRQQGEGRRTNFPLAELAPMPWKRAPPNERGSLPPQRFKGAGPTFAPSSPGERTPKCPLGPFGPPRALFNL

SEQ ID NO: 86948 - DNA, 810 bp, Zea mays
  misc_feature: Ceres CLONE 1573658
  misc_feature: Encodes the peptide sequence at SEQ ID NO. 86949
  misc_feature (12)..(12): n is a, c, t, g, unknown, or other
tggagctcaccncggtggcggccgctctagaactagtggatcccccgggctgcaggaattcgtctcacccctagaaaaaatctcccatcccactatcacgattatcctcaccaccctcccaatgccacagagaaatatctcatcttctctccaccggatctgttcaatctacagcgaggtagaaagggaggtggtgcttctaggggggacgagattttccctgtttccatccatataagggtatgatctgcttacctcaccttccccactcctacgtcgaccacctccacgaccgcctcctcgacatcgtcttcttcctctctattcccatacattaccaaccgattttaactaaattattactaattgtattatgcacatctcttgtaaactgcactcgcctttgcatgttcgtgccccttttaccctttctcttcccatttacactcaatctctccttattcgtctccggccacttctaacccagcggatggtatgtatcccaatgtcctcaaaactgtaggccttttgctccgcaccatccagacgcgatgcacttggcctccatccatcattgtcatctgcggcggcatcaccagcattgcaactgcccttgccctctccaattcttcatttaaggcgactgctttggaatcgagacatcatattggcgggcacattcatactgataactcaattggatgcccaattgatatgggagcctcatgtctacactgcatgtgcaatgagtatccactgccaccattgataagctatcttggggctgaggttatactgcaccagcgatga

SEQ ID NO: 86949 - protein, 104 aa, Zea mays
  misc_feature: Ceres CLONE 1573658
  misc_feature: SWISSPROT Homolog: EC 1.4.3.4 Amine oxidase (flavin-containing)
MYPNVLKTVGLLLRTIQTRCTWPPSIIVICGGITSIATALALSNSSFKATALESRHHIGGHIHTDNSIGCPIDMGASCLHCMCNEYPLPPLISYLGAEVILHQR

SEQ ID NO: 86950 - DNA, 857 bp, Zea mays
  misc_feature: Ceres CLONE 1573659
tggcggccgctctagaactagtggatcccccgggctgcaggaattcgtctcacccctagaaaaaaactcccatcccagattaggattagccgaccacccggctaaaggcagagagaaatatctcatacttctctccaccggatccgttcaatttagagcgagggagaaagggaagtgttgcgtcgaggggggccgagattttcccggtctcgagccagataagggtatgagctgcttaccgcaccgccgccactccgacgtggcccgccgccgggaccgcctcctcgcacatcgtcttcttcctctcgattcccatacgtgccactcaatgttcatttcagtggcactaattgaagtagcaatcgtcttgaaaactggcggacgcccttgtagtgttccagcaccgtttgcgtcgatctcggccctctttcctctcaatctctgcttatttcttctctttccacggcgaagccaagcgacgttatggcatcccctggcctcaaaaatgtagggcttatactccggacgaacgagacgctgtgcatgtggcctccgtccttccttgatatcggaagccgcatcgccctccttacaacttctcgttccctctccaattcttcattgaaggggccggttctggagatcgaaacaacctatatgttgggggaagtccattccgaacacctaaagtggattcccctaggaggggaccgggcagccttctggggttatacgggaggagtggcagtgggcaacccctctggccaccccttttgaagaaacctcactttttgggggcttaaaggtcttttaactccccgcccagggcgaagggataaaccttcaggggttcaagg

SEQ ID NO: 86951 - DNA, 1109 bp, Zea mays
  misc_feature: Ceres CLONE 1573660
  misc_feature: Encodes the peptide sequence at SEQ ID NO. 86952
  misc_feature (14)..(14): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
tggggtggttgtcncgtgggaggactggtgtgtggccttttttttactttgtgccgcgggaggcaggccgagnnnntgaaagctggagctccccgcggtggcggccgctctagaactagtggatcccccgggctgcaggaattcgtctcacccctagaaaaaaacacaacggcacagtagctttactctgacagactgcatggatgggactgcaccctcacttactttgcaaagatgtatgcgtctcacttcgaacgtgataaaactaatacgatggagaggctatggggtgagaacttctttgaccctgccacaaagaagtgcacccccgataacaccggttctcctacctgcaagagaagattcgataggttgggctatgagccagtcaagcaaatcatcaagacctgcgtaactgaccccaaggagaaattgtggcccgtgctgcaaaagttcaatgttaccatgaaggctgatgagaatgagttaacaggcaaagctttgcatgaactgcgttatgcaaaccctggcgttccagctagcacatggtcatgctccaagatgatggactattcccactctttcctgtccctccgcaaacagctcaagaaatattcgtggttggacaaactccgcgacggaatggacaccacccttgaatgaatgctagtaatacgcacctgccttgatttaataaaacgggtagatgacacaaaatgcgtgccatgccagaaaagccctgggaatcgatcttacgacacgaatggacgtttccctggccagccgctgaaccaagggggaatagggaatttcactattgcccccttttaagagccacgcggctcccttgctctcccgaggggcaatggtattggcattagaccggagacatatgcagaaaatttctccggataaatccacttagtggcgttctcacaagagcataagagggaactccccctcgggcggcgcacttataccctaaagagggattcctttcatttttcgcacgtataagaaaaattaggcgaaaacacacatgagattacatgatgggagctaagagctcccctgtgtcacgttgcgcggatacctcccgacctgcccct

SEQ ID NO: 86952 - protein, 142 aa, Zea mays
  misc_feature: Ceres CLONE 1573660
MYASHFERDKTNTMERLWGENFFDPATKKCTPDNTGSPTCKRRFDRLGYEPVKQIIKTCVTDPKEKLWPVLQKFNVTMKADENELTGKALHELRYANPGVPASTWSCSKMMDYSHSFLSLRKQLKKYSWLDKLRDGMDTTLE

SEQ ID NO: 86953 - DNA, 1231 bp, Zea mays
  misc_feature: Ceres CLONE 1573663
  misc_feature: Encodes the peptide sequence at SEQ ID NO. 86954
  misc_feature (1)..(1): n is a, c, t, g, unknown, or other
  misc_feature (18)..(18): n is a, c, t, g, unknown, or other
  misc_feature (64)..(64): n is a, c, t, g, unknown, or other
  misc_feature (1050)..(1050): n is a, c, t, g, unknown, or other
  misc_feature (1075)..(1075): n is a, c, t, g, unknown, or other
  misc_feature (1119)..(1119): n is a, c, t, g, unknown, or other
  misc_feature (1231)..(1231): n is a, c, t, g, unknown, or other
ngaaaagcaataaaaaanaagaaataaaccaccaagttaaaatgatcccgcccgttcaccaacntaacactccccccccaaagctggagctccccacggtggcggccgctctagactagtggatcccccgggctgcaggaattcgtctcacccctagaaaaatccatctatccatcaccaccacctccttctcattcccacgactcccgagcgctttctccgcctgcgtgtggcggcagcatggcgactgccaacgggagcaacaaggggcctttctacgtgcccaaggtggaggtcaggttcaccaagctcttcatcaacggcaagttcgtcgacgccgtctccggctagacgttcgaaacccgggaccctcgcaccggcgaggtgatcgccaccatcgcggagggaggcaaggccgacgtcgacctcgccgtcaaggccgcccgggaggccttcgacaacgggccctggcccaagaagaccggatacgaacgaggttcggatcctccacaggtttcgcggaacctgatcaacccagcacctctaaggagcatggacggcgcttgaacaccggtgagaagtacggggtaagcctggtttcgcaccgttgttgttaaagtgcctcgggacaccatccccaatgggccgcccgactacaaaccatgttatgacgaccatactataccacatcgggacagctccttaccccaaccaaaggggcctgcaatcagggatataacagcaaaatcattacataaactaaattggattggtccgagagtcggggagaagatgtgccaaatcgtgggaggggagaacccgaaacgttggcggaccaaaaagggagaagaggcccctccccttctttagcggtaccgcttgtgagcgtatgggagcgcgaccaaacacaacttaggtgtgggcgccaccttcgtgtaataacgcttacacctctctccattgcactcgcagagtgaagttaccccaacaaacatctacacagaagggaaagatggcgggtctacctaccgcaacattcccttaccccantacagggaccttttattctctatanttcaaaatacgggtagaaaattttccctcagcctccagggacanagaacaaagccgtgctctggtaatgaaacagccttcactttcagtgaggctgcgcactagtatttgtcctccaaggtagtggaatgtggacctaatcccccaccacatagtn

SEQ ID NO: 86954 - protein, 36 aa, Zea mays
  misc_feature: Ceres CLONE 1573663
  misc_feature: SWISSPROT Homolog: EC 1.2.1.3 Aldehyde dehydrogenase (NAD(+))
MATANGSNKGPFYVPKVEVRFTKLFINGKFVDAVSG

SEQ ID NO: 86955 - DNA, 834 bp, Zea mays
  misc_feature: Ceres CLONE 1573665
  misc_feature: Translation starting site: 152
  misc_feature: SWISSPROT Homolog: EC 1.2.1.3 Aldehyde dehydrogenase (NAD(+))
ccccgcggtggcggccgctctagaactagtggatcccccgggctgcaggaattcgtctcacccctagaaaaaatccatctatccatcgccaccacctcctcctccttcccacgactcccgagcgctttctccgcctgcgtgtgggggcagcatggcgactgcgaacgggagcagcaaggggccgttcgaggtgcccaaggtggaggtcaggttcaccaagctcttcatcaacggcaagttcgtcgacgccgactccggcaagacgttcgagacccgggaccctcgaaccggggaggggatctccaccatcgcggagggaggcaaggccgacctcaaactcgccgtcaaggccgcccgggaggccttcgacaacgggccctggcccaggaagactggatacgaccgtggtccgatcctccacaggttctcgagacctgatccactagcacgtggaggagctggcggcactggacactgtggacgcccgcaagatgttcaccgtgcgcaaggcgcgggacatcccaggcgccgcgcacctgctgcgctactacgccggcacctccgaacacgtgcacggctcgacgctcaagatggcgcagcgggatgcacgggtacacactcaaggagcccgtgggcgtggggggccaaatcatgccctggaactaccccaccagcaagttcttccttcaaggtaggggcccgccctcgaacgcaggtggcacctactttcttcaagccccgccgagcagaagccgcttgaccaggactttgtttactcggccccatgggccggggaagggccgggcgttccccgccccggcaatggctcaaacc

SEQ ID NO: 86956 - DNA, 809 bp, Zea mays
  misc_feature: Ceres CLONE 1573666
  misc_feature: Encodes the peptide sequence at SEQ ID NO. 86957
ctcaccgcggtggcggccgctctataactagtggatcccccgggctgcatgaattcgtctcacccctagaaaaaatccatctatccatcaccaccacctcctcctccttcccacgactcccgagcgctttctccgcctgcgtgtggcggcagcatggcgactgcgaacgggagcagcaaggggccgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggggttggtgggccacatcgtgcccctggaactaccccaccaccatgtttcttctttcaaggaagggcccgcccctcgcccgcagggctgcgcccgtcgtccgtcaagcccctgccgaagcaagacgcccggctggttcggcggctcttttattacggcgcaccttctgcctaggc

SEQ ID NO: 86957 - protein, 217 aa, Zea mays
  misc_feature: Ceres CLONE 1573666
  misc_feature (30)..(216): Pfam Name: Aldedh Pfam Description: Aldehyde dehydrogenase family
  misc_feature: SWISSPROT Homolog: EC 1.2.1.3 Aldehyde dehydrogenase (NAD(+))
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVGGPHRAPGTTPPPCFFFQGRARPSPAGLRPSSVKPLPKQDARLVRRLFYYGAPSA

SEQ ID NO: 86958 - DNA, 1145 bp, Zea mays
  misc_feature: Ceres CLONE 1573667
  misc_feature: Encodes the peptide sequence at SEQ ID NO. 86959
  misc_feature (12)..(12): n is a, c, t, g, unknown, or other
  misc_feature (13)..(13): n is a, c, t, g, unknown, or other
  misc_feature (64)..(64): n is a, c, t, g, unknown, or other
  misc_feature (72)..(72): n is a, c, t, g, unknown, or other
  misc_feature (73)..(73): n is a, c, t, g, unknown, or other
  misc_feature (76)..(76): n is a, c, t, g, unknown, or other
  misc_feature (77)..(77): n is a, c, t, g, unknown, or other
tgtgtgtttganntgtattcgtgtgtcccccgcccttgccgtggccctggcgcgctctttcatncgcccctnnttnnccaacctggcgctccccgcggtggcggccgctctagaactagtggatcccccgggctgcaggaattcgtctcacccctagaaaaatgaagaaaacgccggctcgctcgctccgtctctctctctcctcgctgcatatctttcctttgccgcttgctgtctccctcgtctctctccagtcttcttcaccaccctgcttcctccctcttcctcttttgtttcatcagagagaaaaaaaactagatttagcgagggcggaccgacgactcagtagaagcaaccgagacatggaacggcggaggaaggcaatgtggctgtaccccaaggtggtcggcttcaacccaccggaaaggtggggccactccccctgcttctgccaaggcttcctctacctcttccaggggatgctggcggaccgccttcactttcggccacctgcctgaaacctgaacctgggagacccctggctctgggaagtcttgtggggccaacaaccgggagcagtgaccccgggccaccccgtagaacagccccaccggcggccacccactttggagggggaccaacccggagagtggcattcgaccctatccggggggggtcgtcccattctggtggcctgttccagaatataggctgtaaaacctccacacctccgtcccaccgcgtggctctggaggcccacccgtgccaatgtctaaagcatgtgcgagtaagaaatgagggaagagaacgcgcccccctacttcataggtgtgggaaagtccgcggggggggcagtccacggcacctggcagactgtcacccgcctgcttgccgagatacataataaccctgtaatcccctagtattgagcccgtccctttgatcgcgagggagaggacgaaaatcgtgcgctcttctttgtactcgacctccacgcccgtctgccgcgaccccctacgcgcagcggtcgacccaagaggaggaggccacttaccctttcagcttatggagctgccctatcacccctctattcggtagaacacaggagatatccctcccgccagatgcatgttgtaggtccgcca

SEQ ID NO: 86959 - protein, 51 aa, Zea mays
  misc_feature: Ceres CLONE 1573667
MERRRKAMWLYPKVVGFNPPERWGHSPCFCQGFLYLFQGMLADRLHFRPPA

SEQ ID NO: 86960 - DNA, 904 bp, Zea mays
  misc_feature: Ceres CLONE 1573677
  misc_feature: Encodes the peptide sequence at SEQ ID NO. 86961
aaagctggagctccccgcggtggcggccgctctagaactagtggatcccccgggctgcaggaattcgtctcacccctagaaaaaaccgccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacagcagccttcccggcgacttcggctttgatccctggggcctcggatctgacccggagagcctgcggtggaacgtgcaggcggagctggtgcactgccggtgggcgatgctcggcgcggcgggtatcttcatccccgaatttcctgaaaaaaattgggggtccctaaaaaccgcccttcttggaaccccgccccggcgaaccacaagtaatttttacggaaaaccaaccaccccttctttaatcaattggaaccttcaatccttcatccgatttggggccccgaagggcccccacgatttggggctggaatatcagtcaaacgcctcggaaaacgggtaaaaccccgagatccccacctttccccgaggaaaacaaggttcacccgggccaccggaaggtaaggggaaacccgggggtgggccatggggaatttgaaccccgcctacggcaggggggctccccgccccccccgggaaaaaattcattgggggcttgcccgctccttgggggcgattaggaaaacggacccc

SEQ ID NO: 86961 - protein, 191 aa, Zea mays
  misc_feature: Ceres CLONE 1573677
  misc_feature (73)..(184): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDSSLPGDFGFDPWGLGSDPESLRWNVQAELVHCRWAMLGAAGIFIPEFPEKNWGSLKTALLGTPPRRTTSNFYGKPTTPSLINWNLQSFIRFGAPKGPHDLGLEYQSNASENG

SEQ ID NO: 86962 - DNA, 880 bp, Zea mays
  misc_feature: Ceres CLONE 1573683
  misc_feature: Translation starting site: 337
  misc_feature: SWISSPROT Homolog: EC 4.2.3.19 Ent-kaurene synthase
  misc_feature (1)..(1): n is a, c, t, g, unknown, or other
naaagctggagctccccgcggtggcggccgctctagaactagtggatcccccgggctgcaggaattcgtctcacccctagaaaaaaaccccgtggccgagactgatatagctacatggctaagccagtgaacatggatcctgtcttcttctctccaatgaatgccaccaattgccacttaggctcaaacggacatgctcagtgcatccccgccgagataccgtccgtgaggaggacgacaacgccacgaaccgcatcgccctctaccccccctgcgactcaggttagccctggcacaggctagcaacactctgaatcatcatctcaaactacgataatgcagcagctccagcaagtcgatgtacttgagaacatggggatttctcgacaattggccggtgaaatcaagtgtatccttcacatgacatacagatgttggttacagacacactaggcaaattatgcaggacacaaccacatgtacgatggcatttcgtatgtctacgatgaatggatatgatgtcggatgtgatctgtcgactaacgagacggataggtcctggatccaatatccacttatgatacatttcaatgacacaagaatcttgtctgactttcacacgggctcctacgttattaacgctgaaagactagtcaattcctagatagcatatgccttagggccatcgtcctttactaatcagaatcggatgcgctcttaggtggtggctactcctaaatgccttccactaatttaaggaaggtggggaacaaggcctggccaacccattcgcattacttcctccctgcgtgtgggaaacgtttcatacacccccccaaaggggggaaagaattttgccaaaatttttccaaataagggg

SEQ ID NO: 86963 - DNA, 1108 bp, Zea mays
  misc_feature: Ceres CLONE 1573688
  misc_feature: SWISSPROT Homolog: EC 1.2.1.3 Aldehyde dehydrogenase (NAD(+))
  misc_feature (59)..(59): n is a, c, t, g, unknown, or other
aatgtgagataaaaaaaataaaattaaacaaccttaatattaaaccccatttcccctcncccactattcactaaaactggcactccccgcggtggcggccgctctagaactagtggatcccccgggctgcaggaattcgtctcacccctagaaaaatccatctatccatcaccagctccttctcctcctttccactactcccgaacgctttttcctcctgcctgtcgctgtaccatggcgaccgccaatggtagcacctagccgcctttctacgtgtccaacgtggaagtcaggttcacgaagctcttcatcaacagcaaattcgtcaacgccgactccggaaaaacgttcgagacccgggaccctccgaccagccaagtgatctccaccttcacggagggaggctaggcctacctcaaaacttccgtcaaggcccccccgggagagcccttagactaacggtacccttgtccccaggaaatatccggcactcccgacctctggagtttggaaacccctccccccagggtatccgctgtaaccctggattctcacctaacccccctttttatacgcattctgtggcccccccccctggggaacacatgtgtggaaaacctcacgccccaaaaaatttttcccctccccttgggcccacataatcaccccgccgggggacccaacctcccggggagtggtcccccccgtagtataaacccaatgggtgggtccacaccccctttcttatctactatctccgtccgcgggacaaagctatgcctacacactacaaaaaaagtgtgttgtcttaagaggcgatcttgcgaacaccctttattaaaaaacaatttgggtggcacccatgcggagtaaatactcgcccagcggttaaacctaccccttctttcttaatcagatctcccacccattatttgtgccttacattggaatggtcaccaaaacatttccctgtgggcccgccgtaaaaaaattaaacacttgcgtggagagtcaaagatgttttaacatttcgatcgctaatgtattaaggaggaccccccctttttgtcgccccctcaaaaagagggaggcaaccctctctcctatg

SEQ ID NO: 86964 - DNA, 658 bp, Zea mays
  misc_feature: Ceres CLONE 1573697
  misc_feature (120)..(120): n is a, c, t, g, unknown, or other
  misc_feature (129)..(129): n is a, c, t, g, unknown, or other
  misc_feature (348)..(348): n is a, c, t, g, unknown, or other
aaagctggagctcaccgcggtggcggccgctctagaactagtggatcccccgggctgcaggaattcgtctcacccctagaaaaaatgccgctagttgccgctctgctcggtctccagcgngcagcagcngcccagctgagacccctccactcgcccagccctatctccctcacggcgccctccctggtgctcgccccccctgcgggacgccgctcctcaccctggtggtcgagctctcccatggacgccagtcctcatcctcaggttgcccctcccatggcgtttgttcctgccccaaccatggatgccctcccccctcctgcagtacgttaattgatcacgtgctantggaagacgagtggaagtgatctccaggtgatgctgttggacgaagcctaaatgggatgaatcaaccaagtgcccaggatgggaagatgcttcacccaaggggtcgtcaataaacaaccctaacctagtggttatccccggggtaaaaattttggtccctggtggggggaaaggggcctaaatggccccggggggggcctccgcccctctttatatttaaacggggggggggcccccaaagtcccccccaaaaaaaacaaaaaaatgttggggggaccccccggggaaaatcccccaaagggtcccccca

SEQ ID NO: 86965 - DNA, 1009 bp, Zea mays
  misc_feature: Ceres CLONE 1573701
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
ttaatttgaagtgttttatgacgaagttgcgtggagtgtactccgtttttttatcccgcctcagaaagaaacaagtagaaacaatnnnnnnctccannntnnnnnaaaactgggactccccgcggtggcggccgctctagaactagtggatcccccgggctgcaggaattcgtctcacccctagaaaaagcttccccctcccgcgaatcattcgattcggcccgcctcgtctcgcccgcccgattcgatttggccgtcagggtgatcggagccggcgctagggttagggttccggcgatccccatacctatggtgcagctgccgagcttcggggaagcggcacgcggagccggccatggctccggcgcggcgcgcggcgacggtcaagctagaggtggaggagctcggggccgacgagcgctgcccgctcagcaagcccgccaaagcagctctgcccgatggcccccgaagccctccgcaagccggaaggcaggataatggttcccacaaatgtacttccgatgaaaccctaccccccattgggggtcttgccgggttgaaaaaaaaaaggcccccctcccccttcttttgggaaattttgaaatttcccaaaaataaaagaactttttttctttacaagaacaatcccccaaatgggctctgggggcccaaaagttccctctcccccccattgggggaaccacaaaacccaccgcggggggtttttcccttgagaagccccctttttctccaaacgggggagaagaaaaaggggccccccacttttaacttccctggggggggggccctttttcttgtgccaaaataaaaggggggggaaacacccacactcttaaaaaacgcccctctccaaaaaattttttttcccccgccgcacgttttttatttttgaggaaaaaaatatggggtttcttcagttggaaaaaatttttttttttctcccacggggttcacaaaaagggtgttttttttgggggggcgaaacaaa

SEQ ID NO: 86966 - DNA, 693 bp, Zea mays
  misc_feature: Ceres CLONE 1573702
ctcaccgcggtggcggccgctctagaactagtggatcccccgggctgcaggaattcgtctcacccctagaaaaaacctcaggcctcgctcagatctctccgcccgggtccatcttcccccccaaaccttctcccgcctctctcgtcaacgccgcccgacgagagggatggcggccttgcgggctccggccgcaacgctcctcgtcctcctcgccctagcggcggccggcggcgtggcggccgacgggctccgatcaccggtacaagattcgcgaggcccgtccccgcttctacgcccaacaaaggtcgggccccatttttcaccaattcccccagttgaaaaaccttaatccgaattttttttccgaacccctggccccttttttcttggccctcctccccccggggaacaaaaaaagttgggaaaaaggggaaaaaaaaaaaaaaaaccccccaaggggggccccccccccctttttgtggggggggaaaaaaaggggtttttcctctcctccccaaaaaggggggggggggggggaaaaattcccgggggggggtttttaaaaattttttttaaaaaataaggggccgcccccccccttttttttaaaaaaaaaaaagaaacccctttgggggaaaaattttattttctcccccccccgggggtgggcgccccccccaaaaaaaaatttta

SEQ ID NO: 86967 - DNA, 851 bp, Zea mays
  misc_feature: Ceres CLONE 1573705
  misc_feature: Encodes the peptide sequence at SEQ ID NO. 86968
  misc_feature (688)..(688): n is a, c, t, g, unknown, or other
  misc_feature (689)..(689): n is a, c, t, g, unknown, or other
ctccccgcggtggcggccgctctagaactagtggatcccccgggctgcaggaattcgtctcacccctagaaaaatgcttcctgcttttcgtcctcacctcccttcccccactctcttctctccccgcggcccgtgactcatccacccacagtccactcgccactccccccggaacggcggcggcggcgacggcggaggagtaacgcaagatggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccggcggacgccatcgctagggccaagcactatctcgccatggcgcccggcggtctaggtgcgtacagtgactcccgcggcatcccgggaatcaggaaggaagttgccgacttcatccacaagcgtgatggatatcccagtgatccggaactcatctacctcacagacggtgccaagcaaaggtgttgatgcagattctgaacaccatcattagaaacgagatgggatggggatcnntggtccctgtttcctcagtaccccactttattccggccaccatttccccttctatggggggttcctccggggcccggtactaacttgggaaggaaaaggcctaactgggaggccttcgacttttgggggattattcccggcaaaacaagttggtcgggaggc

SEQ ID NO: 86968 - protein, 143 aa, Zea mays
  misc_feature: Ceres CLONE 1573705
  misc_feature: SWISSPROT Homolog: EC 2.6.1.2 Alanine transaminase
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGAKQRC

SEQ ID NO: 86969 - DNA, 902 bp, Zea mays
  misc_feature: Ceres CLONE 1573709
  misc_feature: Encodes the peptide sequence at SEQ ID NO. 86970
  misc_feature (27)..(27): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (93)..(93): n is a, c, t, g, unknown, or other
ggggtggtggtgtgtgttgtagtggcntaccttagcaccaactgcgccggagcgggcattaaatttnnnnnnttttaaagctggagctccccncggtggcggccgctctagaactagtggatcccccgggctgcaggaattcgtctcacccctagaaaaatcttcgttctgagctctctctctctctctccctacccaccaaatctcgcagtcgcagcaggtccaggtgctcccgaggaatccattcccaatttgcgttcccactcccaccaccgcttcttcccgtatcccttgtcctccctaatttcctctcacaaaaagcgggtgcggcttcctgccactcacctcggtctcggggggcgcccgtgctgctggtttcgctccaggggagaaggggcagagggagtagagcaggttaagtccgtttgcgttttcttttgcgggtttgtaggtcaaaagctccgcgagcactttccgctccacctcctcacgctcggaatcaaatcgatgcccccctgatttggttcctggcatcggcgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcaactgttatgtgcgcgcgggccgttatggagtgaaacgaagcgtccctcgcagggctgtggggtttattacccccccctggtttgcttcccccgcagccttgccccttgtggcccatactttcttttgcctttttgttcacgccccgtaaaccggggggcctcctttgggaggtattcctggaggggcttttggccagttttgggccaaagttccacaaat

SEQ ID NO: 86970 - protein, 41 aa, Zea mays
  misc_feature: Ceres CLONE 1573709
MSLLQEISLLVRRQGFCEVTRLLPLGAPHMSGRFDLCPLRE

SEQ ID NO: 86971 - DNA, 1333 bp, Zea mays
  misc_feature: Ceres CLONE 1573717
  misc_feature: Encodes the peptide sequence at SEQ ID NO. 86972
  misc_feature (64)..(64): n is a, c, t, g, unknown, or other
  misc_feature (826)..(826): n is a, c, t, g, unknown, or other
  misc_feature (904)..(904): n is a, c, t, g, unknown, or other
  misc_feature (914)..(914): n is a, c, t, g, unknown, or other
  misc_feature (1000)..(1000): n is a, c, t, g, unknown, or other
ctcttttttcccttttcctttgttgcgcggacagggggtggcagccggagaaaaaaaaaaatanatatataatggaactcaccgcggtggcggccgctctagaactagtggatcccccgggctgcaggaattcgtctcacccctagaaaaattgaaccgccaccagtctcttccattgaaccgcggtcgtaagacgcctcacccaacaccgcgcccaccaccccaaacgacgcctacattcctgacttcccctcctacgcgcagacgccgtcccaccgccgggatgccgccggcgatcccaagcctggtccacccgtcccgtgtgcggattctccacccgggcggaagccatattcacgggccggtggtgtactggatgctgcgggaccaacgtctcgcggacaactgggccctcctccacgcggccgaactcgccgctgcgtccacccccgcggcgccgctcgtcatcgcttttacgctattcccacgggcctttcctccctaggggcggcaccttccgccagcttagggttttccctcctcccgcgggggtcccgccggcccttggccgcgcggatggcgccacggccccggcgggcgctgcccccgttccctatcgtagcttccgaggggtgggggactcctggcgggaaggcttgcctcgtacgattttgtgttgccgggacaggaacttccagtgagggcctttgccgtggagcgcgcgcatggtttcggcacgcgaagacttgttgcatccgttcgcccaacctggaccgagtgtgatcgttggattgtgactgagatgatagagtggtccaattattantgcgtaaatagcggcctcttggtctctccggggcgcgcctacggatgggacccgcattcttactctgagtgcaggggngtgagaacantcgctctctctcgcctcaaaatatctattgtgtggcggcccctcgctgagtctaccgagaccataagagcgattttggggaaaccnccgccaatcttgagtcgaggataggtggtgtatgtgtggggggaccttgtgatgcacgctgtggaataatcatgggcgatattcccaaaggggggaaaaaaactcccactcccagatgttctgctctttgtcttgggtcgcgcaagaaaaactcacctctatggtataatcacatagatatatacgggttcgtgagaacagagagtgtggagtgatgaaaaaaaacacggagaggataatagtgttggtggggcgggggaggcacaccctcctcttggaggaggcgcttctccgatcatcatgtgggggtggagagtcttcatgtgggtgtcg

SEQ ID NO: 86972 - protein, 73 aa, Zea mays
  misc_feature: Ceres CLONE 1573717
MPPAIPSLVHPSRVRILHPGGSHIHGPVVYWMLRDQRLADNWALLHAAELAAASTPAAPLVIAFTLFPRAFPP

SEQ ID NO: 86973 - DNA, 1203 bp, Zea mays
  misc_feature: Ceres CLONE 1573719
  misc_feature (13)..(13): n is a, c, t, g, unknown, or other
  misc_feature (17)..(17): n is a, c, t, g, unknown, or other
  misc_feature (60)..(60): n is a, c, t, g, unknown, or other
ccattttttttcncttncactctgtctcggggggttatcggaacccggaggcgttggtanaaaaggttattttataaagctggagctcaccgcggtggcggccgctctagactagtggatcccccgggctgcatgaattcgtctcacccctagaaaaaatttcagaagctctcgcgacttcctcagcaatcaatcagctttccagcgatctggcagctccgcgatggtgttctaagctcgcaatcggaccggcctcactccccctgttgccactagctaggtgatcaaccgaaagggactaccgcggcgccctacgactgccggcctgcgttcagcttccacccctccgatgagctagctcgagatgtaagtaacacctctttaaatggggttggcctgcctctctgcgctccggtcatggtgcgaggtggatctccacaagttcaacccatggaaacctccgagagacagcgatctgcaggagagaaagggagtggaaactttcttctcttcgtacgcgaccccctgtaaaccggtaatggccttcaggtccagggcgggaccgggattgaaaaatggggatcctggttagggcctatgcgccgggaaaagaacccgggggatggatttacggagggaaaaccggtgggttcctttatagaaagggcgattcgcgttagtttatacagcgctggggaaaagctcgtcgccagggggcgtgtcacaaatacccacccttggttttcatagcaaacgaagataccccgtgccacactctgtagaaaggagggacgtcgcgctcccaggctccttgtggggcaagtgtgtaacacgaatgtgaatcgaatgtgtataatcacttttaaaaagtaagtgagtgactcaaaaaatgccgtgggcaataagtttccaacacacatcatttgttaaaataaactgtacaaggggtgtgataataacactagatgggacatataaataacatccgcgtgggggaactagaaaaggaaggcagttggggtctaaccatggtgtacgaaagagggagatcagggaaaagactgggtatcacatgcaggcgggagaggattgggcggcgcaacagggggggtggtatcccggaggagatatctttgccgcacgtgtttaagtaatagagctctcatgatcaggtgtgtcgcacccctttcacgcgctcacccc

SEQ ID NO: 86974 - DNA, 861 bp, Zea mays
  misc_feature: Ceres CLONE 1573722
  misc_feature: Translation starting site: 219
ggagctccccgcggtggcggccgctctagaactagtggatcccccgggctgcaggaattcgtctcacccctagaaaaagttgtcctcctccgcttccctccaaatccagcctggatccaaccccgattttccccagcggaagcaaacccgagcaaattgagcgcttgcagcttcacccggcgaagcacaatcgaatcggagccgctcgccactccgcgatggggatcctcctccggtccctcctcgacgcctcgctggtcctcggttcgctcgtcttgcacgtcgcaccggctaaaactatagatccttacaaggttctaggagttgacaagaatgctagccaacgggatattcagaaagcctttcgcaaactttctctaaataccaccctgacaagaataaagggaagggcgcacaggaaaaatttgaagaaataaacaatgcatatgagattctgtctgatgaagagaagaggacaaactgtgacctctacggggatgagaagggtaaccctgaatttggtggtggaaattctggaaatcatgggggttctacatacgtcactggtggtggccctaagtcccgtcaactcacgtctggtaatggatggcaaacgatgggtggtcaaggaaatacaaaaacgttttcattttcatttggtggtaaacctggggccagtggggggaaacccggtttggggggggttttgatcctgctggaggtttttgtcgaacctttttgggtggagggaccaaagggggtggaaggaccataattgggggggatccaggtgggccccaccctaggacccgaaccgcgtgaaaactttttgggtcgggcctttgtgtgggccgcacccca

SEQ ID NO: 86975 - DNA, 854 bp, Zea mays
  misc_feature: Ceres CLONE 1573723
  misc_feature: Translation starting site: 211
ccccgcggtggcggccgctctagaactagtggatcccccgggctgcaggaattcgtctcacccctagaaaaaagctcccgcgcctcctcctcgtcgcttcactccaaatccaccgaggccaccggccgggcccgggggaacctcttgcgccgccgccggctcgggcgctctctcgcgcgcgcgtgcgtcgctccgacagcagctgcagccatggcgcagccgctcgtcgtgaagaaggacgacgacctcgacgaggaagagtactactcgccattcctgggcatagagaagggcgccgtgctgcaggaggcccgcgtcttccacgaccctcagcttgacgctcgtcgatgctgccaggttatcaccaagctcctgtacctgctcaaccagggtgacacctttaccaaggttgaggctacagaggtctttctttgcaaccaccaagctgttccagtctaaagatgtgggccttaggaggatggtgtacctcatgatcaaggaactctcaccttccgccgatgaggtcatcatagtaacaagctctttgatgaaggacatgaatagcaaaaccgatatgtaccgtgcaaacgctattagagttctttgtcgtattatcgactcaactcttctcaccaaatcgagaagttatttgaagcaagcccatgttgacaagaatcctgttgttgccagtgcaccccctggtagggggcatctacttggcttcaaacaaagtccgggaggttgtaaaaagatggaggcaatggaagtttcaagagggctgtggcatccaaagaagctgctccttggtgcagttttcaggcgcctttgcctcttctctccccccaaataagaaa

SEQ ID NO: 86976 - DNA, 1215 bp, Zea mays
  misc_feature: Ceres CLONE 1573724
  misc_feature: Translation starting site: 213
  misc_feature: SWISSPROT Homolog: EC 2.3.1.91 Sinapoylglucose--choline O-sinapoyltransferase
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (889)..(889): n is a, c, t, g, unknown, or other
ccattttccccatatcgcgcctttccggcgagcgggggccttctccccacgccgggcgccnnntttataaaaaaataacgggactccccgcggtggcggccgctctagaactagtggatcccccgggctgcaggaattcgtctcacccctagaaaaatacgtttcgtttgttccacctgcgcaactgcgacggggataagtacgtcttccagatgacgacggcggcatggccgcggccacgcttcctcgtcctcccccagcctggattcctccgctcggtctgccacggcctctgcgcccgctgtctcttctgcttcctgctgctcctcgccttcgcctgcagctccagctccggaccggtgggggtcaccagctttgcctggcttcgacggcgacctccccttccacctcaaaacggggtacgtggaggtggaggaggacgccggcgtggagctcttctactacttcgtcccgggcgcgagtccggcgcccgccgcctgcccaccgaagaacaccccttctccctcttttggcttcaccggggggggaaccgcttgcctccggtctttcaagcgggggcgttgccctagcgaagaacggggccccccaatccaaaatttcttgtcccttggaaaaccccttatcaaaccggagtccccctgggcccccgcggacctattgcgtaaataacaaacctcaaccaaaactttccgtgggggctcgcaaacgcgaggttgtataaaccacgcgattatcccctcttgctcctggtagtccggggagactctcgacctcccggctcttcgctggaacaccccacgaggagagttttattctcccgtatatcttcgtcacaaaagaagagcatccctccgccgcaagaggggcnttaagcgagatagtgttctgatggaagaagaacagttttgtggtgggggtcctatcatcattgtggcacgtgccaagagcgcggggtgatatttgtccgctccacaaacaagggacggcgcggtatacaacgggaagtaaaccctcccccggagagaatacgccctcccccgccagaagccctatttctcctctaatctatgtgggggcgggggggaagaactcctcttttagttctcccggagaacaaataacgggtcgcgctttatctcctctccgcgcgggaatagacggtatttttctctcccgcgcgcgtttgttgcgctg

SEQ ID NO: 86977 - DNA, 815 bp, Zea mays
  misc_feature: Ceres CLONE 1573728
  misc_feature: Translation starting site: 268
  misc_feature (624)..(624): n is a, c, t, g, unknown, or other
tccccgcggtggcggccgctctagaactagtggatcccccgggctgcaggaattcgtctcacccctagaaaaagcctagaaacgggctcgcgcgggcgccgtgcctccgcggtttggccatctctatatacagcgagggatcaggcaataatcgcaaatcccacaccaccgcaatcatccacaaccagagccaccctgccgtcgtaggcgcacgcgccgtagataggaagcttattaagctagcgcgtgtcgctgcgccatcctgccatggaggatcaggcgctggcgccgctgctgcagccgctcccgctcggcgaaacgggggccatcaaggggcgcgcgaggcgggcggcgctggagtggtgggtggagtcgaagaagctatggcacatcgtgggcccggccatcttccaacggatcgcgctgtacggggtcaacgtcgtcacgcagtccttcatcggccacctcggcgacctcgagctcgccgccttctccattgctgccaccgtcgtcgggggcttcaacttcggtttcctgctgggaatggcgagcgcgctggagacgctgtgcgggcaggcgttcggcgccaagaagcaccacatgctggggggtgtacctgcagcngctcctggatcgtgctcctcatcttcgccgccgcgctgacgccgacgtacatcttcatggaggacctgctgctgctgatcgggcagtccccggagctgtcgcggttggcggggcaaatgagcgtgtggctgctcccgcagcacttcgccatggcgatgctgctccccgctccgcggttcctgcagagccag

SEQ ID NO: 86978 - DNA, 818 bp, Zea mays
  misc_feature: Ceres CLONE 1573730
  misc_feature: Encodes the peptide sequence at SEQ ID NO. 86979
agctccccgcggtggcggccgctctagaactagtggatcccccgggctgcaggaattcgtctcacccctagaaaaaaacctcccccatcctcattgctcaccaacactattaaacccacccctgacacacatctggttcatttctggttgctgccttgctcgtactacccctcctagcaggcatcccagaacatatatagccacatcgatgtcaaccacgtgctcctattggtgcttacatcccccctagctaccatgtcatggcttcgatgctccaagactggttgtgtcaacagcctccttccgaggcctccgggttgttccgtagtagggaatctgttccacgtgatcctgcacagacggcccatcatgtacctggtgcgccacctccggcagaagtacggggccatcttcaccatgccgatggagcagatcaccctcatcgtggtcacttcgccggagctcatcgacgacttcctggtgaagcaggaccccatgttctcgccccagtatgaggatatccccacacgcctcctatttactgtcagcgagtagcacgtccactaggtgccctacggccccctgtcgcgtgctctgggcagaacgtcctagccggagatcgggtcccgcaccacgtcgagggcttcatctgaatccgggagtagggctatgtaagtgcacttgcccttgctctacacaaattttgaggagaatcgatgccatgcggttcatggggcatttgcccccttatcatttagtggcatgcctattaagaatttaaaatcggccgcgaagatccccggagaagctttgcgggg

SEQ ID NO: 86979 - protein, 99 aa, Zea mays
  misc_feature: Ceres CLONE 1573730
  misc_feature: SWISSPROT Homolog: EC 1.14.14.1 Unspecific monooxygenase
MSWLRCSKTGCVNSLLPRPPGCSVVGNLFHVILHRRPIMYLVRHLRQKYGAIFTMPMEQITLIVVTSPELIDDFLVKQDPMFSPQYEDIPTRLLFTVSE

SEQ ID NO: 86980 - DNA, 869 bp, Zea mays
  misc_feature: Ceres CLONE 1573731
  misc_feature: Encodes the peptide sequence at SEQ ID NO. 86981
ctccccgcggtggcggccgctctagaactagtggatcccccgggctgcaggaattcgtctcacccctagaaaaagcctaccccgtccctccccaagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacaggcaccgcagcggccgggagcaccgtgaccgggacaaggatgacgtgaaggaggagaggagccgcgaaagccgcgggaaggacagggacagggaagggagagaacgggagaaggagaggggtgacaggcaccggctgagagagagggaagtggaacgggagcggaggagccggagccgctcggagcggcgccgtgccgaggaagaggagatggttagggagctggagcgggagcgcgagcgcagcgagcgacatcactatcgcgaccttgatgtcagatatgatacgatagagccgtcttcagatgttatctgcaatttgggcctgactcaggatatcaggcgttggaaaagataacggggcggagccagaagttgatctttaacggagacggagggacgggactcggctttccgtctttccccttcccccttaccttaaggaaggaaaaagaaaaacgttttttttcttttcttccaggttgaaagtcgagtcttttaggacgatcaggtttatgttttgttgggaccgggaacttcaaa

SEQ ID NO: 86981 - protein, 175 aa, Zea mays
  misc_feature: Ceres CLONE 1573731
MEFDEYEYLEKAVEPAPPQANGSGSGSGEKDRGSRRREGGEDRISKRSRSGEDRDRDRHRSGREHRDRDKDDVKEERSRESRGKDRDREGREREKERGDRHRLREREVERERRSRSRSERRRAEEEEMVRELERERERSERHHYRDLDVRYDTIEPSSDVICNLGLTQDIRRWKR

SEQ ID NO: 86982 - DNA, 763 bp, Zea mays
  misc_feature: Ceres CLONE 1573742
  misc_feature: Translation starting site: 211
  misc_feature (465)..(465): n is a, c, t, g, unknown, or other
  misc_feature (475)..(475): n is a, c, t, g, unknown, or other
  misc_feature (487)..(487): n is a, c, t, g, unknown, or other
ctggagctccccgcggtggcggccgctctagaactagtggatcccccgggctgcaggaattcgtctcacccctagaaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccagggcctaaccgggcggncgggacaggntactggaagggncaccggcgcgaacagccggtagggtcgccgcgccccgtggccatcaagaaggccctcgtcttctacgccgggaagcgccccaagggcgtcaagaacaactggatcatgcacaagtaccgccttggggacgtcgaccgcttcgccgccgcaagcaaaaagaacaaacaacccgctccaggctgaaaactggggtgcttttccccgaatcaccaaaaagaaagggggtttttcaagggggtcccaacccatgggaacaaaaaaaaaacggggaaagga

SEQ ID NO: 86983 - DNA, 845 bp, Zea mays
  misc_feature: Ceres CLONE 1573743
  misc_feature: Encodes the peptide sequence at SEQ ID NO. 86984
ggagctccccgcggtggcggccgctctagaactagtggatcccccgggctgcaggaattcgtctcacccctagaaaaaattaaaaagctctcgagacttcctcggtaatcaatcagctttccagcgatcggcagctcctcgatcgtttcgaagctccaatccgcccggtcgcctccgcctgttgccactagctaggtgatcgatcgaatggactgcggtggcgcgctgcagctcccgcctgggttcagcttccaccccaccgatgacgagctggtgatgtactatctcctacgaaagtgcggcggtctggcgctcggcgcgccggtcatcgccgaggaggatctctacaagttcgacccatggcagctcccacagaatgcgttcggtggggagaaggagtggtacttcttctcaccgcgcgaccgaaagtacccgaatggctccaggcctaaccgggcggacgggacagggtactggaagggcaccggcgcctacaagccggtagggtcgccgcgccgcgtggccatcaagaaggcgctcgacttctacgccgggaagccgcccaatggcgtgaagactcactggatcatgcacgagtactgcctcgcggacgtcgaaccgttcgggtcgccgcacgcaagaagagcaacaacgcgctcaagctggatgactgggtgctgtgcctgatctacaacaagaaggatgttatcgagcggtacgacacagtggacgacgacgaccggcacggcgctgtggctcaggaggtacagccggtgcctggggcagctgcgtccaaataatctacgtgccagtgcccgtttaggggccacaacagggggcagcga

SEQ ID NO: 86984 - protein, 159 aa, Zea mays
  misc_feature: Ceres CLONE 1573743
  misc_feature (9)..(134): Pfam Name: NAM Pfam Description: No apical meristem (NAM) protein
MDCGGALQLPPGFSFHPTDDELVMYYLLRKCGGLALGAPVIAEEDLYKFDPWQLPQNAFGGEKEWYFFSPRDRKYPNGSRPNRADGTGYWKGTGAYKPVGSPRRVAIKKALDFYAGKPPNGVKTHWIMHEYCLADVEPFGSPHARRATTRSSWMTGCCA

SEQ ID NO: 86985 - DNA, 838 bp, Zea mays
  misc_feature: Ceres CLONE 1573746
  misc_feature: Encodes the peptide sequence at SEQ ID NO. 86986
ggagctccccgcggtggcggccgctctagaactagtggatcccccgggctgcaggaattcgtctcacccctagaaaaaacagagctcgagagatcgtcaggagagagagagagaggggactgagagcatagatagacaccgagcgagaacatgagtaatctagctagaagacactctcgttccaaacaaacatcacagtggctagctgcgggatctccgaccccgccgacaactaccgcaccaccaagcacctgatggcggccaccggatctgcctgcctgagccgcaaccccaccgtgcaccaccgggccggcgggttccccagcagagtggcactgacgaacacgcatcacccccctcttctatctcgccgctatcttgtcttcgcctctgcgactagagcctaacaggacgccgcccctgtgacgatcgacgacttgtacctcagctctcatcatgccgcgtccgaccactgagagctcgtctcgctgagacatgaggtccacggcagcaacaactggtagggtctgctggaccccatcaactgcgtgctcctccaggagctcatcgactacggctagtcgcctaggccacctacgacagcttcgactacgaccagctctccacctactgctgcagctgaaactactcggcgaatacatcatacacgacatcggtcttgacggcatctgctacgaggtaattttctacgtctacgacgcctgcaacgaccataagtaacccatttttcggcatacagaccggctcctacgcctgaaatttcgtacgaagttccggacggttcatcggggttacatggcccgtgccacccgaccag

SEQ ID NO: 86986 - protein, 81 aa, Zea mays
  misc_feature: Ceres CLONE 1573746
MRSTAATTGRVCWTPSTACSSRSSSTTASRLGHLRQLRLRPALHLLLQLKLLGEYIIHDIGLDGICYEVIFYVYDACNDHK

SEQ ID NO: 86987 - DNA, 835 bp, Zea mays
  misc_feature: Ceres CLONE 1573747
  misc_feature: Translation starting site: 174
  misc_feature: SWISSPROT Homolog: EC 1.14.13.11 Trans-cinnamate 4-monooxygenase
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
ctccccgcggtggcggccgctctagaactagtggatcccccgggctgcaggaattcgtctcacccctagaaaaaaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccgcatggggcagcgcaacctggtggtggtctcgtcgccgccgctggcgcgggaggtgctccacacgcagggcgtggagttcggctcccgcacccgcaacgtggtcttcgacatcttcacggacaaggggcaggacatggtgttcaccgtgtaccgcgaccactggcgcaagatgcgccgcatcatgaccgtggccctcttcacaacaaggtcgtgcagcagtaccgccaccgctgggagggcgagggcgccccccttcttctacaaaatgggcctcgaaccccaaggggggccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaggggcccttaaggggggagacc

SEQ ID NO: 86988 - DNA, 781 bp, Zea mays
  misc_feature: Ceres CLONE 1573751
  misc_feature: Encodes the peptide sequence at SEQ ID NO. 86989
  misc_feature (664)..(664): n is a, c, t, g, unknown, or other
  misc_feature (669)..(669): n is a, c, t, g, unknown, or other
  misc_feature (672)..(672): n is a, c, t, g, unknown, or other
  misc_feature (673)..(673): n is a, c, t, g, unknown, or other
cccgcggtggcggccgctctagaactagtggatcccccgggctgcaggaattcgtctcacccctagaaaagtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccaggggcaacgccactgtccctgctatggagatgaccaagtggtttgacaccaactaccactttattgtcccggaattgggcccaaacaccaagttctcctatgcttctcacaaggctgttaacgaatataaggagggctaagcgctcggtgttgataccgtgccagtacttgttggaccagtctcgtacctgttgctctcaaagcctgccaagggtgtggagaagggattcccntctcnttnnccttcttagcagcatcctttcagtctacaagggagtcattgctgagttgaaggcagctggggcttcatggatttcagttgatgagcccactcttgtcctcgacttgaa

SEQ ID NO: 86989 - protein, 144 aa, Zea mays
  misc_feature: Ceres CLONE 1573751
  misc_feature (2)..(145): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEG

SEQ ID NO: 86990 - DNA, 854 bp, Zea mays
  misc_feature: Ceres CLONE 1573752
  misc_feature: Encodes the peptide sequence at SEQ ID NO. 86991
ggagctccccgcggtggcggccgctctagaactagtggatcccccgggctgcaggaattcgtctcacccctagaaaaaatggacctcctctccggcaagctcatacgctccctgcgtctccattcctcactcctcccctctgctccttcctcctcccgcgccgtccccacatcccgccgtctccggcgccgccgccatgcccccctgtactgccgccttaccaccacctcctcctcctcatctgcctccaccaccacaaccaccggggtggaggaagacgtcaaaagccaggacctttcctccctcctcacctcctccgacccttctgccgcgcccgccgtcgggaccaagaagaagcggtcgggcggcagcagcggcgcgtctagcatcccgtccggggtgcggctggagggaatctccaagtcctacaagggcgtgacggtgctcaaggacgtgtcctgggaggtgcagcgcggcgagaaggtggggctcgtcggcgtgaacggcgccggcaagacgacgcagctccgcatcatcgcggggctcgagaagcccgacggcggcgccgtcatcaaggccaaggagaacatgaagatcgccttcctcagccaggagttcgaggtctccgcctcccgcaccgtcagggaagagttcttcagcgccttcgaggaggaagatggaggtcaagcgggcggctcgagcaaggtgcaggccggcggctcgaggggcgccactgaaagacatgggacttcattgggcccgggctcccttcgaatgaagcttcgaccttggctgcaagcggccggctttcccagggacggtgggaaccttccgaaaaatggggggggaacgct

SEQ ID NO: 86991 - protein, 258 aa, Zea mays
  misc_feature: Ceres CLONE 1573752
  misc_feature: SWISSPROT Homolog: EC 3.6.3.17 Monosaccharide-transporting ATPase
MDLLSGKLIRSLRLHSSLLPSAPSSSRAVPTSRRLRRRRHAPLYCRLTTTSSSSSASTTTTTGVEEDVKSQDLSSLLTSSDPSAAPAVGTKKKRSGGSSGASSIPSGVRLEGISKSYKGVTVLKDVSWEVQRGEKVGLVGVNGAGKTTQLRIIAGLEKPDGGAVIKAKENMKIAFLSQEFEVSASRTVREEFFSAFEEEDGGQAGGSSKVQAGGSRGATERHGTSLGPGSLRMKLRPWLQAAGFPRDGGNLPKNGGGT

SEQ ID NO: 86992 - DNA, 788 bp, Zea mays
  misc_feature: Ceres CLONE 1573753
  misc_feature: Encodes the peptide sequence at SEQ ID NO. 86993
  misc_feature (639)..(639): n is a, c, t, g, unknown, or other
agctccccgcggtggcggccgctctagaactagtggatcccccgggctgcaggaattcgtctcacccctagaaaaaatccacaccccggtcggctagtcccaaggctgctgccgccgcctgccgctaggggatcgcttgctttcctcggaccactctgccgaccacatctacaccgcatcaacggtccttccaagtgagctccaatcccctgtctgtagatggagagggtgctaaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgtgactgttacaaatgatggggctaccattttgaagtcacttcacattgacaatcctgctgcaaaggtccttgttgacatctcaaaagttcaagatgacgaagttggtgatgggacaacttctgttgttgttctagctggagaacttttgaaggaggctgagaagttaattaacatgaaaattcatccgatgactattattgcaggttacagaatggctctcgagtgtgccagagattctttgctaaaaaagaccatggancacaaagaaaatacagataaattccgatctgatctcatgaatattgctatgactactcttagttcaaaatactttcccaagaacaggtgtacctcgctgaacttgcggttgatgctgtcttgaagcctaaaggtagcaccaactgggaa

SEQ ID NO: 86993 - protein, 180 aa, Zea mays
  misc_feature: Ceres CLONE 1573753
  misc_feature (140)..(140): Xaa is any aa, unknown, or other
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTMXHKENTDKFRSDLMNIAMTTLSSKYFPKNRCTSLNLRLMLS

SEQ ID NO: 86994 - DNA, 839 bp, Zea mays
  misc_feature: Ceres CLONE 1573755
  misc_feature (839)..(839): n is a, c, t, g, unknown, or other
ccccgcggtggcggccgctctagaatagtggatgccccgggctgggggaattcgtctcacccctagaaaaagccccgggcccccttttgtttaatctcggcaaccattcaccgtcctccccctctcctctctctctcgtctcaacaactcgacggacggcgcgacttcacttccactctccccgcgcgcgggctcgccggacatgcgccaagccgccgaagcacatagacagagcccggcggttcggcacttcggccatgcgggggtgagagtgggaggaccggtgcaatgagcacccggaccaccgcacgtccgaaggcgtctgcccgtactgcctcagcgaccgcctggtgcagctctgcggctccgcctccgcctcggcggcccccaccactaggcgcgcctcctcctcctcttcgtcggagaccacatacgagagctcctgcggcggctcgtccacgtcgcggcaccacgacgcgctctccgcggacgtcagctcggtacacgttggcgccagctcctcatgtagatacgccgctgctctcttctcgcagccgctgatgcccgagctctgtcagtaagagagcgccgactaccccggctggcagcggggaggcgagacgaagccgcgctacctgcgaggggggaggcggaggtgaggaggcagaagatcgggaggttcctgtgcaggacgctcttgggcgaataacggcggcacacctgggactggagcccgcgatctcgtccactccagaaccttgaaggaaaaagacggggtgccaggtgcgtgttcctctggaaatccacctatcccagaccaggggccccgaaaggccccn

SEQ ID NO: 86995 - DNA, 931 bp, Zea mays
  misc_feature: Ceres CLONE 1573770
  misc_feature: Encodes the peptide sequence at SEQ ID NO. 86996
ccccgcggtggcggccgctctagaactagtggatcccccgggctgcaggaattcgtctcacccctagaaaaagcggatggccgtcgttgacaccagctagtagcagccagcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctgggaccagttctcttcactgcaagcccaccatgggcactgggcttggggatttccagcgggattatgtttcatcctgcccggggtttggaattttgcccttggaatggcccctggggttccctgaatgtttggtccatatcccccccggaacattctgaccttggagaattttgcccgccttgcattcctagcgaccccacccttaaacccaaaaaattggggggaatgggggggcaccccctttttatttgggggttccgaaaccacccgggggttgggcgaccattgcttcaaaaattaacttctccctttggagggctttcccccgtggtgagggaggcaattcggccaaacagacggggggtgtgtgggtgtaagggggggggttgccctgggacatctatacccccagtggggggggccaaccctttgagttccccccagtgggggaaaaaagaaagcccttttcgggggagtg

SEQ ID NO: 86996 - protein, 261 aa, Zea mays
  misc_feature: Ceres CLONE 1573770
  misc_feature: SWISSPROT Homolog: EC 5.4.99.8 Cycloartenol synthase
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALGPVLFTASPPWALGLGISSGIMFHPARGLEFCPWNGPWGSLNVWSISPPEHSDLGEFCPPCIPSDPTLKPKKLGGMGGHPLFIWGFRNHPGVGRPLLQKLTSPFGGLSPVVREAIRPNRRGVCGCKGGGCPGTSIPPVGGANPLSSPQWGKKESPFRGS

SEQ ID NO: 86997 - DNA, 852 bp, Zea mays
  misc_feature: Ceres CLONE 1573771
  misc_feature: Encodes the peptide sequence at SEQ ID NO. 86998
  misc_feature (468)..(468): n is a, c, t, g, unknown, or other
  misc_feature (558)..(558): n is a, c, t, g, unknown, or other
ggagctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgagggcccagtccccgcgcggccccgtggaggcggcggcgggtggntacgggtggtgggcccgtggaaggccggggggctaccggcgggtgggcggggcccccttggatgggccgggccggccgtcctacccgccngtttggccggccggccggcttacggggggcgggcgggcggcctaccggggggggggggggcgggcggcttccggggggtggggaaaccggggggggggggggttacgggaaaattcccaaacggggaaaccggggaggaaaactctaaccggggggggggccccccccccgggccaaaatttatcctcgggttccccccacccgcgggtgttttgttttcccccctcaaaacccccaaagaggggtgtttttctcttttgcttgtgggcgtccccgagaggtttttgttgtggg

SEQ ID NO: 86998 - protein, 225 aa, Zea mays
  misc_feature: Ceres CLONE 1573771
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (98)..(98): Xaa is any aa, unknown, or other
  misc_feature (128)..(128): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEGPVPARPRGGGGGWXRVVGPWKAGGLPAGGRGPLGWAGPAVLPAXLAGRPAYGGRAGGLPGGGGAGGFRGVGKPGGGGVTGKFPNGETGEENSNRGGGPPPGPKFILGFPPPAGVLFSPLKTPKEGCFSLLLVGVPERFLLW

SEQ ID NO: 86999 - DNA, 841 bp, Zea mays
  misc_feature: Ceres CLONE 1573777
  misc_feature: Encodes the peptide sequence at SEQ ID NO. 87000
ccgctctagaactagtggatcccccgggctgcaggaattcgtctcacccctagaaaaaacctgcgaagccctcattcctccggcttctccgagccctagccccaaccccgaccgcccatgtccgccatcgtggcctcctcggccgccgccgcttctaactccgatgaggaagaaaactatgaggagtacatcccagtcgccaagcgccgggccatggaggccgagcgcctccgccagctccgcctctccaagtgagcggcggcctcggccggctcatccctcccgatgccacctcccccgcctctttttgccagcgcagacctccgttcccgacgccgccgctaagcccaggcttctagggaaggccacgcagcgttaagcgcgcggccccggaggtgaccgccacggagcagcgcatccatcaggagaaggaagtgattgaaaatctctcagacaacaaatcgctcaggtcagtccgcgagatcgctcaggggatcatctacacggaaaccgatccagaccgggtggaagccgcctctccacttccgccgtatgccgttctgccaaagccaacgagtttccggtgcaagtggcacatcatcgacgacggggacaatttagcaccaccggcgcgtgattttccgggatctcccgcctccccgaacccatgctcccgaatcttcacgagaaggggatcggcccccccacccccgattcaggggcatggggtgcccggttgggctcttttggggcttttcattggtagcgaattgggtttgacggggccttttgaaagggtcctggggaaaagatcttcttttatctagggggatccccctaa

SEQ ID NO: 87000 - protein, 45 aa, Zea mays
  misc_feature: Ceres CLONE 1573777
MSAIVASSAAAASNSDEEENYEEYIPVAKRRAMEAERLRQLRLSK

SEQ ID NO: 87001 - DNA, 821 bp, Zea mays
  misc_feature: Ceres CLONE 1573782
  misc_feature: Encodes the peptide sequence at SEQ ID NO. 87002
ccccgcggtggcggccgctctagaactagtggatcccccgggctgcaggaattcgtctcacccctagaaaaactccccaactcgccgtctgccttctgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaaggtatgctttaaggaatttttgtttcaaaagcctctagtataatggtatgtgctacttttgcagaatttggtgctagtataatagttttggagttgaatacaggatttgtgaaatgattatagtggctagagcttccattacctttctggttcttttctatttaagtagttaggttaacttaatagcattcattaggtttgctaggaatgat

SEQ ID NO: 87002 - protein, 167 aa, Zea mays
  misc_feature: Ceres CLONE 1573782
  misc_feature (5)..(168): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVCFKEFLFQKPLV

SEQ ID NO: 87003 - DNA, 1244 bp, Zea mays
  misc_feature: Ceres CLONE 1573788
  misc_feature (906)..(906): n is a, c, t, g, unknown, or other
acccttttttcccttttcctagtgattgcttaatcgaacggccaagtggaaatgaaggaagtttttttttttagttggagctctccgcggtggcggccgctctagaactagtggatcccccgggctgcaggaattcgtctcacccctagaaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaaccttaggtgcgccgtaagaggaagaaggttttggtggactacttggtgaagttccgatagatccgcgtgatcgtcgtggtccttcctgttacaactctgatctacttcaacatcttcctgggcgacatgtgggccgccatgaacgcagagaataagcgccagaagcagtacaacgagaacgtgcagaaggtcttgaagcggctcaagcaagaagaacccgaaaaaaggcctgtctttgtttgcaccggccaagaaagcccctggaaatcgctgttagggcttggcgccaaacggtgggaactaacaaggcgtggccgaaggggcattttccgcagggtccgaacccctcatcttatcccatacgaagggaaaccatctcctattggagaataccgaaccaaataaaacaactggaaatgggttttgcccaccaaaaggatcccgaaagccaccccccattggagtgcaaaaccaatgggagagattcaacgggaaaatatcaaactcccgactcgaagcccacttaccccgcttgggcacccctaaaaatggagaaacccccttgaggcaccccttttggggcgcgggcagtcccgnatgtatacccctaaacactagtgcgggaaaagtgacaacaccgtggacacaagggtgcatagagaaaagggagcgagttatatatattacaaaaggtgcgtttacagcccgagaaaaataccataagaggagggagaacctcctctccccacagcttctcatacagggagtccctatcttttacacgcccgaaaaaacacggtatatggaatctcctaattaaagagaagaaggtattttatccattgtgtaaaaaaacaatgaccccagcgtgtccccacttatagatgagcctcctcaaaggggtaaaaatcatgaacgatctttttgtacaaccg

SEQ ID NO: 87004 - DNA, 884 bp, Zea mays
  misc_feature: Ceres CLONE 1573795
  misc_feature: Encodes the peptide sequence at SEQ ID NO. 87005
  misc_feature (520)..(520): n is a, c, t, g, unknown, or other
ctccccgcggtggcggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctgggctccatcgcgactggcgtcctcatctgggtcatcccgccccccgcgggcntgcccgcaacgcgtggcaactcctaagcattcttcttttcaccattcgtcggattataacccaaccggtggcccttggggggggtcgccctccctcggccttggggcccgccggtggttaacccgaagcctcacgtttgccgggggccttttttgggctttgggggaaacccaaacccccgggggaaaaaggggctctccctttttttttcgcggaggggggggttaaaaaaaaaagggggtcttggggtccccgggggtgccccaaaaccctttttggggggcccctattgggggggccccctcccccctgggggcggggggaaaaatacccactgttatttctccccggaagaggcgccctc

SEQ ID NO: 87005 - protein, 142 aa, Zea mays
  misc_feature: Ceres CLONE 1573795
  misc_feature (135)..(135): Xaa is any aa, unknown, or other
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLGSIATGVLIWVIPPPAGXPATRGNS

SEQ ID NO: 87006 - DNA, 1192 bp, Zea mays
  misc_feature: Ceres CLONE 1573796
  misc_feature: Encodes the peptide sequence at SEQ ID NO. 87007
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1029)..(1029): n is a, c, t, g, unknown, or other
aaaaaaattgtaattcaccctagtttgccgcccgaataacatggaagttacctttnnnnnnntttnnnnnaaaaactgggactccccgcggtggcggccgctctataactagtggatcccccgggctgcaggaattcgtctcacccctagaaaaacttcctcgcccggtcgtccccctttcccccgcggccccgccccccatgtccctcgcgtacgcgcccataccgtaccgctcccgaaacactagggcgcggcacgcaccctcctcgtgagcgcagggtcgggcgcaggcggcatggcgccgcaggccgcggggtccacccttgcggtggcggcgctcgggttcctcctcccgacctgctgggagatcgaggtcacgtgcgccgccacgatgatcctcgtcgcgctctacgctgcgtacgagctcctcaacccgcgccccttccaggctgcagcgtcgggcgacgccgacgagctcctcctgcgggggctaaacggaaccaacaaggggggtgcaaaacggcccgttctgcgtcaggtagtgaaagctcataattgtttggctgcctaggtaattttgattgggtgggcgaaactttaaataggggacatgcttggaccccgataatggcattattatcccaccttgggggggcggccaaaaaaataacccggttttataaaattcacatttgggtttcccctagggtctttccaaaaaagaaacccataaattgattagaggtgccaaaacacttacaattctcccaaccctctctttggtgtggggattggaaatacaaaacacctttcgcccttggttacacaaagagacatacaatattgcctcccccgggagttattatttggagacacttggcgggacctaatttattttttatggttcaaaatatattcgcccaaactctccccctgggggggcaccggcgtggttataaactgcccgtccacttgattataaagctattttgtaacaatatacccgaagagcatgtgggaaacaccatntttgctgtgataaaatatcacactctttgtaacaccgcccacgtagtatattaggtccaccggggggtaataggggaccttgtccctaaaattaaaagagaggtaatcctcctggtgggctccaaccgagagaagaacctatcctcctcccaagatggcctcg

SEQ ID NO: 87007 - protein, 91 aa, Zea mays
  misc_feature: Ceres CLONE 1573796
MAPQAAGSTLAVAALGFLLPTCWEIEVTCAATMILVALYAAYELLNPRPFQAAASGDADELLLRGLNGTNKGGAKRPVLRQVVKAHNCLAA

SEQ ID NO: 87008 - DNA, 881 bp, Zea mays
  misc_feature: Ceres CLONE 1573797
  misc_feature: SWISSPROT Homolog: EC 3.4.16.5 Carboxypeptidase C
tggagctccccgcggtggcggccgctctagaactagtggatcccccgggctgcaggaattcgtctcacccctagaaaaaactggttactgtgtaattgccactttccatcgtaagctcgtagctagctagctaggaaggaccgccgactactttactgcaatggagttagctctgctcatctactatactaccgcagcggcaagcaatgtggtgcctggtctgttaccgcgcgcttgactagcagcctcgcctctggctagctggctgccgtggtagagacaacctccatcctcggcaacgcggcgccccgggccgcactggtgacgagcttcccggggtacggtgaaaagcagcgcttgccgtcgaagcactccgtcgggtacttgaccgtggactaccggcaccccagggggctgttctactacctggtgtagtcctagcccgaccctgaccctgacatcatcgtgctctgattcaacggtggtcccggctggtcaggtgcgacgggttcttttaccagcatggactttcagtatgaagcatacggaaggtcaattggtaacgtgctaaagcttctgtaacccttatatcggcctagggataaattgggaaaaataggaaccccttggcggggtggggcttttctaacttagcaacgtttcggactaacgagaatcggcaattgtcaaaccctccacccaatttcaacaccttttccggggtcaagttgttttccaagtttttccccctggaaaaattcttgggcaaaatcgccgtttttttaaaatgaccctcggagaaaattatatatcacagtgtggggtgttatattgtgtcaccctaaacactttttttaaaaaggggagagaatcgcgggtaa

SEQ ID NO: 87009 - DNA, 832 bp, Zea mays
  misc_feature: Ceres CLONE 1573799
  misc_feature (832)..(832): n is a, c, t, g, unknown, or other
ggagctccccgcggtggcggccgctctagaactagtggatcccccgggctgcaggaattcgtctcacccctagaaaaagttgagagagtcgtcccctccgcgtgctctccgcctgcggcatctgtatcccacaacgaaaaactaccaaaaaaattagaaatccccaaatccgcgagatctatcagtatcgagcgatttaccgatccgattgctagggtttagtttcgaaaaagaaactctgaaaaaaaattctggtcgaggggaggagacgatggcagcgcaaaagtggcggcggtggtggtgccgaatgggagcccgggcgctgtccccgcggtggtgtcgccgggagcggtcggcgtcggactcggcgtggcgcagccgctcccgaccacgtcgctctacgtcggcgacctggaggggtccgtctcggactcgcagctgtacgagctcttcagccaggcggggcaggtggtgtcggtgcgcgtctgcagggacgtcacctcgcgccgctcgctcggatacgcctacgtcaacttcaacaaccccttggatgctgcaaggggcattggaagtgctgaactttgctctccttaacaacaaacctatccgggtgatgtatttcaaaccggtgatccaagtagccgcagggagtggatctagctaacattttccataaaagaatctttgacaagatggatagaacaataaatccccttcattgagaaccgttttctttcatttgggaacccatgtctctcaaggtaaaggtaagcccatgggaatgaaaggaaggcccaactccccaaagggcttttgcggtttttggtttcan

SEQ ID NO: 87010 - DNA, 822 bp, Zea mays
  misc_feature: Ceres CLONE 1573800
  misc_feature: Encodes the peptide sequence at SEQ ID NO. 87011
ggagctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgcccttcgcgggcgcctcgccggcaacgccttcctctccgggaacgtgctcctcaacggccgcaagggcaagctctccttcggcgctgcggcgtacgtgacgcaggacgacaacctgatcggaacgctgacggggcccgagaaaatcggctactcgggcgctgctggggctggcggaacaagataccccggggaggacaaacccccccctgggtggaagggacccatccgccaaaaatg

SEQ ID NO: 87011 - protein, 201 aa, Zea mays
  misc_feature: Ceres CLONE 1573800
  misc_feature: SWISSPROT Homolog: EC 3.6.3.28 Phosphonate-transporting ATPase
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALRGRLAGNAFLSGNVLLNGRKGKLSFGAAAYVTQDDNLIGTLTGPEKIGYSGAAGAGGTRYPGEDKPPPGWKGPIRQK

SEQ ID NO: 87012 - DNA, 825 bp, Zea mays
  misc_feature: Ceres CLONE 1573801
  misc_feature: Encodes the peptide sequence at SEQ ID NO. 87013
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
agctccccgcggtggcggccgctctagaactagtggatcccccgggctgcaggaattcgtctcacccctagaaaaactctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgccnnnnnnnnnnnnnnnnnnnnnnnnnnnnnnnnnnnnnnnnnnnnnnnnnnnnnnnnnnnnnntcccccctcatttgctcaacctccgacctcgcgcgaacaagcaagccaaagtatggccggacagcaacagccgccgtggcgttcggggtcttcggccgggccgcgcgcgcagaggaggtcttctgcgggacccgcccctcggcttgtcggtggtgcgggccgcaattca

SEQ ID NO: 87013 - protein, 62 aa, Zea mays; identical to SEQ ID NO: 5990
  misc_feature: Ceres CLONE 1573801
  misc_feature (1)..(62): Pfam Name: TMA7 Pfam Description: Translation machinery associated TMA7

SEQ ID NO: 87014 - DNA, 958 bp, Zea mays
  misc_feature: Ceres CLONE 1573809
  misc_feature: SWISSPROT Homolog: EC 3.2.2.22 rRNA N-glycosylase
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ttttnnnnnnnnnnnnnnntttttttttccttgggtggggtgggtnggtttnntnnnnnnttnnnnnnnnnaaaagctgggactccccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgcatagcatctggaaatgtgggtgcagcagctccgatactgagagcagattacataaaattgaacttcagcaccgcttcggcgacccccgacaagtacaagagcttcatcgcttctgttcatgctggcttggtgagcaaagcggggggcaacagcagcgggatccccgtgctggacgacgaagacgacccgctcgcgctcgaatcgtttctaaacatcactctggtgaacaaagcagggcgctccgtaagcttgaagatggatgtctccagagcctacttcgtggcttacgtagcagggcagcgctcgtgcctcctcaagagatcaggacgcacgttctcgtcggcgatctgttactacagcggcccgtgaggaacaagttcggcgtctgtcacgcgacctgctgctgctgccggctacggcgaggatcctggggacgcggcatgtcgatctacaaatttctacgaggcaaacccatcgctgtttctgttcccagtggaccacaggggaacaccccccctagaagaattcctagacgggggggttcttctctcgggcaaaatcaaagttggtgacacaaggataacgtttcattattggaggccttgcatattcgaggc

SEQ ID NO: 87015 - DNA, 821 bp, Zea mays
  misc_feature: Ceres CLONE 1573811
  misc_feature: Encodes the peptide sequence at SEQ ID NO. 87016
ggagctcaccgcggtggcggccgctctagaactagtggatcccccgggctgcaggaattcgtctcacccctagaaaaaatcctcgcccgctacaccatttgcgaacgggtcgcgcccgagcccgatatgcccgcgaagcgcaggtgcagccagacccaaagcggtgcgacggagatcgtgagatcgcgcgccggagcctcctaccccgcccccgacgccggcgatgacctccgcagtcctcgccggccggaatgaggtccaccaggcgcatcagcaccaccgccgatgggctggcgcccgcgtcgcgctcatgaccaagccggcctccaaccctaaccctaggagccaccgggcgggcccaaaccctatccacagtggctcgacgccggagccgcgggccgctccagacgtcgcggcctagccctcgtcgtcacctacagggcacctgaacttcacgccgtctgaaatgacccccggcgaggccctggacctccgcacgcggatcaccagcgaggtctgccgaggccgcgctttcctatcccgtatcgactcgtggcagggggggccggccaccgtccgcagccaaccaccaacttcttacaaagaatacgatgtttcagctggacgtgaaacgtgctggggagtgaagcacctgtgccatgttcccccaagcagtggcgcgaggcttcaggaatgctcatgcaccgtctccaactgcctttcgtcctcggggtttcaggggaggggcctcatccctggaagaagccccatcaaggcccgggcgaagtctgctgccgggaagggccccttatccttggaag

SEQ ID NO: 87016 - protein, 65 aa, Zea mays
  misc_feature: Ceres CLONE 1573811
MTSAVLAGRNEVHQAHQHHRRWAGARVALMTKPASNPNPRSHRAGPNPIHSGSTPEPRAAPDVAA

SEQ ID NO: 87017 - DNA, 865 bp, Zea mays
  misc_feature: Ceres CLONE 1573814
  misc_feature: Encodes the peptide sequence at SEQ ID NO. 87018
ctccccgcggtggcggccgctctagaactagtggatcccccgggctgcaggaattcgtctcacccctagaaaaaactactgatctgaccaagccgtaaacggcaccgccctctcacatctcctctcccctcgatccaagggcgccgccgccgccgccgccgcgccatcccgcaagacggagacctacaccgacaccaagcgccgcgatgacgtgcgcggggccaatatcggcgcagcgcgcgccgtcgctgacgccgtgcgcacctcgctgggaccccgtggcatggataagatgatctgttcgggcgaccaggcgcaagaggtcatcatcaccaaggacggtgccaccagcctctcccgaatggtggtcctccagcgcgccgcgcgcatgctagcggagctatcccgctcccaggacgccgccgctggggacggcaccacgactgttgtcagcctcggtggattcctcatccggcgcgcccagtcgctcctctccgccgggggccagccaaccggagccggagacgctctccagcgtctccgagaatgagctggtgagagcctccccggcagggccaccccctttggggcttcctgaccgggaatcccgcggggaacccaaaatccaatgctctaagcccctaaaggcgaacgtcccattacccccccccttatataaaccccgcgacgatttacccgccttcttcccagaggggggaaccccacacaccccggaactttcgcgaaaaatcggggaaaatcccgcctctttcaaaaaggcttttgtgggaacccctagaaaaaataattagagcttggggaattgggcctcctgtgtttttaaaaaaggaggcgttgtgccccg

SEQ ID NO: 87018 - protein, 88 aa, Zea mays
  misc_feature: Ceres CLONE 1573814
MDKMICSGDQAQEVIITKDGATSLSRMVVLQRAARMLAELSRSQDAAAGDGTTTVVSLGGFLIRRAQSLLSAGGQPTGAGDALQRLRE

SEQ ID NO: 87019 - DNA, 868 bp, Zea mays
  misc_feature: Ceres CLONE 1573816
  misc_feature: Encodes the peptide sequence at SEQ ID NO. 87020
caccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtctcaatgcccttggtgctggtcggattttcccccaaggtgctaagcttgttgatcaaagctcttgcctcaggaaagatttatgatggagaggggttcaactacgtcgaagattcttttcaaaatggcactcttcacctaattggggttgttgagtgatggtggtgtccactcccgccttgaccaactggagttacttctgaaaggtgtcagtgagacaggaaacaaaaaaaattcctggtgcacgtcccttacccgatggggcgtgacgtttttggatggcccccctgtttgggtttccttggaaaaccctttaaaaatgatctttgtgggagcctccgaggacaagggattctcgatgccacccgattggcctttctgggtgggggggataggaagtcattgtttaccattggccaaccgctgtatgtaacaaagaaactgggggaatgtttgccctaaaaaacatgggggtg

SEQ ID NO: 87020 - protein, 108 aa, Zea mays
  misc_feature: Ceres CLONE 1573816
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGLNALGAGRIFPQGAKLVDQSSCLRKDL

SEQ ID NO: 87021 - DNA, 829 bp, Zea mays
  misc_feature: Ceres CLONE 1573818
  misc_feature: Encodes the peptide sequence at SEQ ID NO. 87022
ctccccgcggtggcggccgctctagaactagtggatcccccgggctgcaggaattcgtctcaccccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcggtgcggatgcgcgcgccctctcgcggggtccgcgggggctccgcgctgcgggtcacgtgcgagaaggtggtggggatcgacctaggcaccaccaactccgcggtcgccgccatggagggcggcaagccgaccgtcgtcaccaacgccgagggcgcgcgcacaactccctctgtagtggcgtacaccaagacaggggagcgcctggtggggcagatcgctaagcgccaggcggtcgtgaaccccgagaacaccttcttctctgtcaagcgcttcatcggccgcaagatgtctgaggtcgacgacgaagccaagcaggtctcgtacggcgtttgtcaagacgagaacggcaacgtcaaactcgactgccccgctattggcaaacagtttgctgccgaggagatctctgcgcagggttggaggaagttgggtggaagatgcatctaagtttcttaattgagaaatttacaaagcagtgggttacggtaccagcatacttccagtgattcccaaagg

SEQ ID NO: 87022 - protein, 193 aa, Zea mays
  misc_feature: Ceres CLONE 1573818
MASFTCSQVGAAAAGGTSPFLGYRRRSGPGGAIPSSSLFVGRRLAAVRMRAPSRGVRGGSALRVTCEKVVGIDLGTTNSAVAAMEGGKPTVVTNAEGARTTPSVVAYTKTGERLVGQIAKRQAVVNPENTFFSVKRFIGRKMSEVDDEAKQVSYGVCQDENGNVKLDCPAIGKQFAAEEISAQGWRKLGGRCI

SEQ ID NO: 87023 - DNA, 876 bp, Zea mays
  misc_feature: Ceres CLONE 1573819
  misc_feature: Encodes the peptide sequence at SEQ ID NO. 87024
  misc_feature (263)..(263): n is a, c, t, g, unknown, or other
  misc_feature (265)..(265): n is a, c, t, g, unknown, or other
  misc_feature (266)..(266): n is a, c, t, g, unknown, or other
  misc_feature (478)..(478): n is a, c, t, g, unknown, or other
  misc_feature (480)..(480): n is a, c, t, g, unknown, or other
  misc_feature (876)..(876): n is a, c, t, g, unknown, or other
ggagctcaccgcggtggcggccgctctagaactagtggatcccccgggctgcaggaattcgtctcacccctagaaaaaactgacaggcgccagagagagagagagagagaccacaactcctctcgcctcgcctcgcctcgcctcccccggggaagaagaggaggagagggagctgagcagcagccggccgacgcgggaatgctcgtcggcggcgggcgggacgacgaggaggtgctccggaagctcaagagcatggacgtggnanncaagatcggagaacggcggcggcggcggtgaggcggagagcccgcgccccgccgtcaagtaccacggctggaaggccatgcccttcatcatcgggaacgagacgttcgagaagctgggggacgcttggggcacgttcggggccaaaccctggctgggtgttaccctggaccccggggggtttccccattgtgggggggaggggggggttttntnaaaaaaataattaatcatgtgacgaggtgattactgttgtgggttggtggggcggctatggtggggggggtgggattttataatgagtggtttgggggtctgggacgaaagaatcgggtgataggtattgggggttcgtcggtgcctggtcgtgcggttttattgggggcgggccttgatgtaggcgtaatttttctttttgcctgcgtccttctattcaggttgtgtgtgtttttgcggtgattgttcggggtgataatcgtcgtccttctcgttctgttggcggccctgtttgttggtggtgcggcgggataggttgattatgtgcgtggcgtactgccctcattattgcgttgtgcgcgttgcgtttcgtgtttgtcggcgctgtttctccan

SEQ ID NO: 87024 - protein, 48 aa, Zea mays
  misc_feature: Ceres CLONE 1573819
  misc_feature (45)..(45): Xaa is any aa, unknown, or other
  misc_feature (46)..(46): Xaa is any aa, unknown, or other
MPFIIGNETFEKLGDAWGTFGAKPWLGVTLDPGGFPHCGGEGGVXXKK

SEQ ID NO: 87025 - DNA, 821 bp, Zea mays
  misc_feature: Ceres CLONE 1573822
  misc_feature: Encodes the peptide sequence at SEQ ID NO. 87026
  misc_feature (621)..(621): n is a, c, t, g, unknown, or other
ccccgcggtggcggccgctctagaactagtggatcccccgggctgcaggaattcgtctcacccctagaaaaatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgcttcgccgacctcaccaacgacgagtaccgcgccacctacctcggcgtcaggagcaggccgcagagggagaggaggctcggtgacaggtacctggccggcgacaacgaggacctgccggagtccgtcgactggcgggccaagggcgccgtcgcggaggtcaaggaccagggcagctgcgggagttgctgggctttctcaacaatagcggctgtggaaggcatncacccagatgttactggcgacatgatctccttgtctgagcaggagctttgtgactgtgacacttcatacaaccaggggtgcaatgggaggtttgatggactattgcgtttgaagtcatcatcaacaacgggcggaatcgacacggagggaggattacccttacaagggcacgggacgggaacggtgtgatgtcaacagga

SEQ ID NO: 87026 - protein, 233 aa, Zea mays
  misc_feature: Ceres CLONE 1573822
  misc_feature (46)..(106): Pfam Name: Inhibitor_I29 Pfam Description: Cathepsin propeptide inhibitor domain (I29)
  misc_feature (135)..(234): Pfam Name: Peptidase_C1 Pfam Description: Papain family cysteine protease
  misc_feature: SWISSPROT Homolog: EC 3.4.22.14 Actinidain
  misc_feature (171)..(171): Xaa is any aa, unknown, or other
MGASTTPLASAAALLLLLLAPLAAAADSMSIVSYGERSEEEARRMYAEWMAAHGRTYNAVGEEERRFEVFRDNLRYVDAHNAAADAGVHSFRLGLNRFADLTNDEYRATYLGVRSRPQRERRLGDRYLAGDNEDLPESVDWRAKGAVAEVKDQGSCGSCWAFSTIAAVEGXHPDVTGDMISLSEQELCDCDTSYNQGCNGRFDGLLRLKSSSTTGGIDTEGGLPLQGHGTGTV

SEQ ID NO: 87027 - DNA, 833 bp, Zea mays
  misc_feature: Ceres CLONE 1573830
  misc_feature: Encodes the peptide sequence at SEQ ID NO. 87028
  misc_feature (682)..(682): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (822)..(822): n is a, c, t, g, unknown, or other
ggagctccccgcggtggcggccgctctagaactagtggatcccccgggctgcaggaattcgtctcacccctagaaaaaagaaaccgtgtccttccgtcgtgacagctcccgaccttctggcggtcttcccctctcgtagtcggcgcgaatcccgaggtggaggaggaagaggtagagggggcgggccccatcatccatgagccttgcgggctccgcgctggaggcagcgctactggtggtggggcgcggtctcgacacagctggagaccagcggctgctctactgcaagggagacggaaggctcgtcgcgctcgaggatcgtgcgcgggacctcccgctctccgacagcggcgtcctcgcgagcgtgccccacgacgtcgaggtcgagcactgccgcagagacctcgagcgcgtccgccccttcccgtccgggtccagcccaagctccgccgcagcggactgtccctttgatctgcagcgtcaagaagatggctgagtatttcaacaagaagtcatgtttgtcctacacagtaccgctgggttacgtcaaatctctcttcggctgcgcggttcttggtagaatgatgctgcgacctggaccgcacttgcgattgatggctcttctctggctctgtttccagtgaaagtattacgacttctgaactgacgctgcttgatagcngttagcaaaggatctcgagtcgttgggatccattcggcattgggaaggtcagtcacttatgnnngagacatatggggcccgctattctaaatcactagtcaccgaaggttggtcaagaataaagcattctattttggccncggtgattcta

SEQ ID NO: 87028 - protein, 99 aa, Zea mays
  misc_feature: Ceres CLONE 1573830
MSLAGSALEAALLVVGRGLDTAGDQRLLYCKGDGRLVALEDRARDLPLSDSGVLASVPHDVEVEHCRRDLERVRPFPSGSSPSSAAADCPFDLQRQEDG

SEQ ID NO: 87029 - DNA, 1009 bp, Zea mays
  misc_feature: Ceres CLONE 1573831
  misc_feature: Encodes the peptide sequence at SEQ ID NO. 87030
  misc_feature (1)..(1): n is a, c, t, g, unknown, or other
  misc_feature (13)..(13): n is a, c, t, g, unknown, or other
  misc_feature (20)..(20): n is a, c, t, g, unknown, or other
  misc_feature (981)..(981): n is a, c, t, g, unknown, or other
  misc_feature (982)..(982): n is a, c, t, g, unknown, or other
  misc_feature (983)..(983): n is a, c, t, g, unknown, or other
  misc_feature (984)..(984): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (988)..(988): n is a, c, t, g, unknown, or other
  misc_feature (991)..(991): n is a, c, t, g, unknown, or other
  misc_feature (992)..(992): n is a, c, t, g, unknown, or other
nttttaataaaanaaaaccnggaaattaaacaataaagagaaaaacaaaatctaaataaacgcaaaaaataatttcaaaactggagctccccgcggtggcggccgctctagaatagtggatcccccgggctgcaggaattcgtctcacccctagaaaaactctccctatccatccccaaataatccccacctcccgctcatcctccgcctccgccgcccgccatggcctccctcacctcggcctccacctcactcctcttcccgcaggcctcctcatccaggagccgcgtccggctctccacctccctgggcttctccgcgcagccggcgcggctgcggagccgggcggcggcaggagggcagcggcgcgggagcctgctggtggtgcgcgcggcgaggggaaagttcgagcgcaccaagccgcacgtaaacatcggcaccatcggtcacgtcgaccacggcaagaccaccctcaccgccgcgctcaccatggtgctcgcctccgtcggcggcagcgcgcccaagaagtacgacgagatcgatgccgcccccgaggagcgtgcccgcggtatcaccatcaacaccggcaccgtcaagtacgagaccgagacccggccactacgcgacaacgtcgactgccccggccacgccgactatgtcaagaacatgatcacccggcgctgcccaaatgggacggccgccattcctcgatcgtcctctgggcggccgaccggtccccatggccgcaaaacccaaagaggcactttccttccctccccaaagaaaggccggccgtttccccaaaaaaccgttggtctctcccccccaccaaaaggaacgtggttcgaatcccaaggaactctttcgaatttgcttataagactcgtcactgaaatcccaactcctcaaaacataatacacaggaacagggccattcccctggtcccccccagggcttggggctctggaccccacgaaaannnnnnnnatnntctcctaagggttcttt

SEQ ID NO: 87030 - protein, 262 aa, Zea mays
  misc_feature: Ceres CLONE 1573831
  misc_feature (66)..(227): Pfam Name: GTP_EFTU Pfam Description: Elongation factor Tu GTP binding domain
  misc_feature (253)..(253): Xaa is any aa, unknown, or other
  misc_feature (254)..(254): Xaa is any aa, unknown, or other
  misc_feature (255)..(255): Xaa is any aa, unknown, or other
  misc_feature (256)..(256): Xaa is any aa, unknown, or other
  misc_feature (257)..(257): Xaa is any aa, unknown, or other
MASLTSASTSLLFPQASSSRSRVRLSTSLGFSAQPARLRSRAAAGGQRRGSLLVVRAARGKFERTKPHVNIGTIGHVDHGKTTLTAALTMVLASVGGSAPKKYDEIDAAPEERARGITINTGTVKYETETRPLRDNVDCPGHADYVKNMITRRCPNGTAAIPRSSSGRPTGPHGRKTQRGTFLPSPKKGRPFPQKTVGLSPPPKGTWFESQGTLSNLLIRLVTEIPTPQNIIHRNRAIPLVPPRAWGSGPHEXXXXXLLRVL

SEQ ID NO: 87031 - DNA, 847 bp, Zea mays
  misc_feature: Ceres CLONE 1573837
  misc_feature: Translation starting site: 220
  misc_feature: SWISSPROT Homolog: EC 1.2.1.3 Aldehyde dehydrogenase (NAD(+))
  misc_feature: SWISSPROT Homolog: EC 1.2.1.8 Betaine-aldehyde dehydrogenase
  misc_feature (698)..(698): n is a, c, t, g, unknown, or other
gcggtggcggccgctctagaactagtggatcccccgggctgcaggaattcgtctcacccctagaaaaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggggaggtgattgctcatgtggctgagggtgacgcataggacatttaaccgtgcagtagctgcggctcgccaggcttttgatgaagggcccatgcccgaagatgactgcctatgagaggtcccgtatcctactgcggtttgctgatttgataggagagcacattgacgagcttgctgctttggagacatgggaccacggnaagccataggagcgagcagcccagattgaagtacccatgctgggcccgtcttatgcgttactaatgctggtggggctgataaaatcccatgggctcctttgtggcgggctgaagggcccacacccaggtccagaatcttgcttggagcc

SEQ ID NO: 87032 - DNA, 848 bp, Zea mays
  misc_feature: Ceres CLONE 1573838
  misc_feature: Encodes the peptide sequence at SEQ ID NO. 87033
ggagctccccgcggtggcggccgctctagaactagtggatcccccgggctgcaggaattcgtctcacccctagaaaaaagcgaggagcaccacgggctggaacagaaatatcccagccaaacaactccaccctaccgcgccccaaattcgaaatccttctccgcctctcctcccaccgcagcatcaggcaagcgcgtaggttgatgcggagagatggattctgacacaggtaagctcttcgtcggcggcatctcctgggaaacaacggatgagaagctgagcgagcacttctccgcctacggagaggttacgcacgacgccgtcttgcgcgacaagacgacgggccgcccccgaggcttcgggtttgtcgtcttcaccgaccccgccggcgacgaccgagcgctgcaagacacccacatcctcaacggccgcacggtcgatgtgaagcgggacctctcgcgggaggagctgcaggtctccaagggcgcacaccctagaggtgggaggaacactggcggaggaaatggcggcggcgatgcaaatggtgctcggactaataaaaattcgtgcgcgggctgccctctactctgactgatgatgggtttcggcagtattaccagacattcggcatcgtcactgagatagtagtcatgtatgaccagaacacgcggcgcccccgtggcttccgattcatcaccttttgaatcagaagacgctgtatgacacatgctgcaaaaagacattcaatgatcttgttggggagcctggattgaggtgaaacgggctattgcccctttgagcgcaaaccttgggtgcctcttggaagttggccgtttctgggggtggat

SEQ ID NO: 87033 - protein, 125 aa, Zea mays
  misc_feature: Ceres CLONE 1573838
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDSDTGKLFVGGISWETTDEKLSEHFSAYGEVTHDAVLRDKTTGRPRGFGFVVFTDPAGDDRALQDTHILNGRTVDVKRDLSREELQVSKGAHPRGGRNTGGGNGGGDANGARTNKNSCAGCPLL

SEQ ID NO: 87034 - DNA, 1065 bp, Zea mays
  misc_feature: Ceres CLONE 1573843
  misc_feature: SWISSPROT Homolog: EC 3.2.1.21 Beta-glucosidase
  misc_feature (5)..(5): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
tattnatatcactatttccccggaaggcgggaccgatagaaggatactaaggcgcggnnnnnanantannaaaaagctgggactccccgcggtggcggccgctctagaactagtggatcccccgggctgcaggaattcgtctcacccctagaaaaagcaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaaactgagcccctggcaaatccccaggagggagtggttcccccctagctttatctttggtgctgccacttcagcataccaaattgaaggggcttggaacgaaggtggaaaggggccaagcacttgggacgacttctgccacaaccatccgggagtggaatagcggacgggagcagtgggggatgttaggagcaaaactcctaactatctggtataggggaggaccctccagatttgcttgaagggaaaatggggtaatgggaccgccctaacaaggttttctcccatcctccttgggcccccaaaaaatattttggccaaaaggggggaaccacctccaaggggaagggccatttaaaccaataaagggccattcgaaggtacctaacaaaaaaaaggctgaatccaaccttggttttgaaaagaagaaaccggccttaaacaacccaatattggtgaacaaacttttttccacctgggggaacacaaccctccaaagaccactggggggggaacaggcttaaacggggggcctttctcttaaggatggaatagggaattgtaaaaaaggaatctctccccggcacttttccccaaaagggtggtggctttttggtgggacatttttccgggcgaaaaatactcgtggaa

SEQ ID NO: 87035 - DNA, 1177 bp, Zea mays
  misc_feature: Ceres CLONE 1573844
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (57)..(57): n is a, c, t, g, unknown, or other
  misc_feature (58)..(58): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (88)..(88): n is a, c, t, g, unknown, or other
  misc_feature (1177)..(1177): n is a, c, t, g, unknown, or other
tttttttttcannntggcgggtaatataggaaacatatctgttaatataatagatannctaattntnnngtaaaactggagctccccncggtggcggccgctctagaactagtggatcccccgggctgcaggaattcgtctcacccctagaaaaaatgttgaacgcaccctttgaatctatccaccaccaccgatccagactacgtgcttttcggtcgccggctaccaccacatcgatgtctcggctccgcctcggcctcaggatcagagcgggatctccagctcgcatggccaacgaggagcacgcactcacccgcagggttaggagcagggtgatccggtagtaatggcgaacctgataaggatgatcatgagcacgagaagactcattcccacggcctgctgaagctgctccacaacaagcgctgcatacactgcaataattcgggaccacagataagtctgcacaaatttctgggacattagaaccgtcccaaattgctcgttggatcacattcaagagttaacacccccaagtaaaagacctggttttcctatgggcccagatcttgcccgcccccctggaaattttgtcttgcgccttttgcagaaaagggggggaaaataaaacgcggccttaaaggaaagttattttagggcaacggaaaattgtgtggtattccttctcaaccggaaaaattggaaatttccaccaatttacaaaccaaatgaaaaacggcgatttggaacttattctccttagaggggaacaatatatgcccccctctcaaagggcccatagatattttggtgtggtgcggtaaaattcattccagagtaaaccccctccgccgttggccaccaaagggagagataccctgtgtattcccccgttcccccccaagaagaggcccataacaggaaatctttccgaacgggaaatctttaatttttttctttgtgaaagaaggtttgaaaaaaaaacccgggtatggaacaaaactttgcgggggggggtatacgaacataaactcctcctaaaggagcgtaattgttttacttaagggaattttttataaaatttattggccggttttgtgtctttgcttaaaagagaacagttcccacaacatttcccctatgggggggaaccataaatcctctgtctaaaaccttn

SEQ ID NO: 87036 - DNA, 966 bp, Zea mays
  misc_feature: Ceres CLONE 1573852
  misc_feature: Encodes the peptide sequence at SEQ ID NO. 87037
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (269)..(269): n is a, c, t, g, unknown, or other
  misc_feature (280)..(280): n is a, c, t, g, unknown, or other
  misc_feature (362)..(362): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccnnnnnaaaactggagctcaccgcggtggcggccgctctagactagtggatcccccgggctgcaggaattcgtctcacccctagaaaaacagcatctcaagtcttcacactcctcgccatcacataaaaccagtgcaagcagaagcagcgcaatggcgagcagcaccatggccccntctctcacagncttcgccggcaaggcagtgaacgtgccgtcgtctctctttcgcgaagcccgcgtgacgatgcgcaagacggcgggcaaagcnaaagcggcggggagctccgggaacccctggaacagccccgaaccgtggtctaaccttggccccctgttcggggccccccaagatttctgaaaggggggaatttccgggggaaatacggcttgggaaaccccccggggggttttgcggggacccccgaaaaaattttccccaaaaacccggggggcgggggggggttcccctcccccccctggggcaaacctttgggggggctttggggggggggttgttttcccccgaaaaggtttcttccccccccccacgggggtgttaaaatttttttttaaagaacaccccttttgtgtgttaaataaacaggggggggccggaaatttttttttttctagggggggggggggggggggggaaaaaaaccctcgggaaacccccaaacaccccggttttctcctctccccccgaagaagaaaaacccccccccccccctgggggccgggcccccaccaagagggggctctttgtgggggggcgcccccccacagggggggagggggggggggttccccgggggggggcccccccccctctacaccaaggaggagggggggggcccccccccccccccccc

SEQ ID NO: 87037 - protein, 68 aa, Zea mays
  misc_feature: Ceres CLONE 1573852
  misc_feature (12)..(12): Xaa is any aa, unknown, or other
MASSTMAPSLTXFAGKAVNVPSSLFREARVTMRKTAGKAKAAGSSGNPWNSPEPWSNLGPLFGAPQDF

SEQ ID NO: 87038 - DNA, 792 bp, Zea mays
  misc_feature: Ceres CLONE 1573853
tcaccgcggtggcggccgctctagaactagtggatcccccgggctgcaggaattcgtctcacccctagaaaaagtctcctttcctcccccaatccgccatttggcttctctggcggcggcggcggctggggaaggcaggaatcccggcctttgcttgcgcgccactccgggcaccggctgcagctcgcagaaatggttagccagtagtatgtatgtgcattctgtatatatacaagagagcaatcatttctttggaaaatggcacttccactctgattgttaaataaggtgccttaccctgtggaaaggggttgaactgtatctgtaatctgacactccacatctccagctgaacaaaatggcctccaatggtaatggaaatctcaaatctgatattcaacaagtagagtcaacagcttcggacaatgttcaaggcgcaacaggcgtcaacactcttgctactcagggtgtttcacgacatgaagagccgtggagcgggtttagggatttctggaatcgccttggtactggccccaagttaaagaaacttggtccctccacttcgttcaagtttcaacagatcgcacttcaacgtgatgagttctcacgttcgatccattgcgactaccatgttagccacgagcatttccagttgatgcggaagattactgggaacaactgtgagtgatggctaagaactggatcacagagctatgaatatgccctttcgttcgatgctgtgtgctgatcggggcatgtcatctgtagacgatgctgatggttcgctacaat

SEQ ID NO: 87039 - DNA, 1198 bp, Zea mays
  misc_feature: Ceres CLONE 1573855
  misc_feature: Encodes the peptide sequence at SEQ ID NO. 87040
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (555)..(555): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (645)..(645): n is a, c, t, g, unknown, or other
  misc_feature (902)..(902): n is a, c, t, g, unknown, or other
  misc_feature (906)..(906): n is a, c, t, g, unknown, or other
  misc_feature (949)..(949): n is a, c, t, g, unknown, or other
  misc_feature (950)..(950): n is a, c, t, g, unknown, or other
  misc_feature (1044)..(1044): n is a, c, t, g, unknown, or other
  misc_feature (1060)..(1060): n is a, c, t, g, unknown, or other
  misc_feature (1101)..(1101): n is a, c, t, g, unknown, or other
  misc_feature (1102)..(1102): n is a, c, t, g, unknown, or other
  misc_feature (1164)..(1164): n is a, c, t, g, unknown, or other
  misc_feature (1185)..(1185): n is a, c, t, g, unknown, or other
ntgggtttcccnnnccctttttgttgccctggaccacccctactcataaatcagaaagacttataagcagatataataaaatggaactcccgacggtggcggccgctctagaactagtggatcccccgggctgcaggaattcgtctcacccctagaaaaagactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggtaaacgtcaccagcatcgccggctccctcctcgacggcgtcggcgagttcctcggccgcggcgtcacctgccagcttatcagcttccaccggccgtgggaacccaaacaacgggaaaaccgggggggaaaattttgggggccccccccaaaagggcaaaaccctctgggcaaaagaggggggggtggtgaaaaacacccccccgcccccaatgtttttnttgttcccccgggggaaagaaaaaaaaatttctccctncgtnnccccccccaagcccccttagagaggaannngaggataataaaaaaanaaaggggggtgtctttctcccggggggcgggccccaactctatagattatttatttcaggaaaaaaaacaacaacacccacacagacgcgtcaaacaagaagaaagaatattttcctccctcccacagagagaagaaaaaaaatatacctcaccccccccgctcttgctaaaagggttagagcatagttaaattattcccgggaggagggcgtggagtacatcggtatatatataacacaattctttgtttttgcanattntgatctgttacgaacgtcaccctcagattaaaaatactgatgnnggggggagaggggatgatagtgactatcccacacgccacgctacgagatgagtaagtagacagaagaccgacctattagagaggaggagggttntctgatgattttctcntttaacctaaaccagaagaagaacagcggagccctgtagannaaccatccactccccgccaatgccagaataaacaataaaaagacaaagttgtgagtatcaantatatacgaactcaccgtccncaagatggctatt

SEQ ID NO: 87040 - protein, 203 aa, Zea mays
  misc_feature: Ceres CLONE 1573855
  misc_feature: SWISSPROT Homolog: EC 1.13.11.12 Lipoxygenase
  misc_feature (111)..(111): Xaa is any aa, unknown, or other
  misc_feature (125)..(125): Xaa is any aa, unknown, or other
  misc_feature (134)..(134): Xaa is any aa, unknown, or other
  misc_feature (135)..(135): Xaa is any aa, unknown, or other
  misc_feature (141)..(141): Xaa is any aa, unknown, or other
MFGNIGKIPIIGDLTGSNKNAHLKGNVVLVRKTVLGLVNVTSIAGSLLDGVGEFLGRGVTCQLISFHRPWEPKQRENRGGKFWGPPPKGQNPLGKRGGGGEKHPPAPNVFXVPPGERKKNFSLRXPPQAPLERXXRIIKKXRGVSFSRGAGPNSIDYLFQEKKQQHPHRRVKQEERIFSSLPQREEKKYTSPPPLLLKGLEHS

SEQ ID NO: 87041 - DNA, 829 bp, Zea mays
  misc_feature: Ceres CLONE 1573863
  misc_feature: Encodes the peptide sequence at SEQ ID NO. 87042
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
agctccccgcggtggcggccgctctagaactagtggatcccccgggctgcaggaattcgtctcacccctagaaaaaagaccaccgttgctcgctcgccttcacaacctctccatccaggccacagctcgagaccaacgaccgacgcctagacgcggctgggcggtcggcctcacctcgttccccctcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatctgtgttggagagcgtggttgggaaggatttcctaccgaggggttcaggcattgtaacccgtcgtccgctggtgctgcagctccacagaattgatggtgacagggaatatgcagagttcatgcatcttccgagaaaaagatttacagattttgctgctgtgagaaaggagatagctgatgaaactgaccgagaaacaggccgttcaaagcaaatatcaactgtccctatccatttaagcatattttctccccatgttgtgaatcttactcnnntatgatcttcctggggctactaaagtagcagttgatgggcaaccgggagagtattgtacatgacattgaaaacatgggttcgctcatatattgaaaagcaaaatgtatcatttctggctggttccccagcccatcc

SEQ ID NO: 87042 - protein, 138 aa, Zea mays
  misc_feature: Ceres CLONE 1573863
  misc_feature (37)..(140): Pfam Name: Dynamin_N Pfam Description: Dynamin family
  misc_feature: SWISSPROT Homolog: EC 3.6.5.5 Dynamin GTPase
MDNLITLVNKLQRACTALGDHGEESALPTLWDSLPAIAVVGGQSSGKSSVLESVVGKDFLPRGSGIVTRRPLVLQLHRIDGDREYAEFMHLPRKRFTDFAAVRKEIADETDRETGRSKQISTVPIHLSIFSPHVVNLT

SEQ ID NO: 87043 - DNA, 923 bp, Zea mays
  misc_feature: Ceres CLONE 1573864
  misc_feature: Encodes the peptide sequence at SEQ ID NO. 87044
  misc_feature (9)..(9): n is a, c, t, g, unknown, or other
  misc_feature (10)..(10): n is a, c, t, g, unknown, or other
  misc_feature (68)..(68): n is a, c, t, g, unknown, or other
  misc_feature (70)..(70): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (93)..(93): n is a, c, t, g, unknown, or other
ccccttttnnttcttcccattatataacaaggaaaacaactctttttcttttcttattaaattattgntngntnnccaaactggagctcaccncggtggcggccgctctagaactagtggatcccccgggctgcaggaattcgtctcacccctagaaaaacccacgctgccctcggcgctgcgcctggccccggcacctacctcccccctccccacctcgcccccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagaccgactgcgtgctgaagctcctgcaggccggcgcccaatatcctcatgtttccgactcccaagcacggggcggaacctgccctggcaccacggcggtcctaacttcgggccacattcggcctgccttgcaggccatcccttcacgggcggcgcggaaccaacgccgggtgggccaaactacatagtggggggctttcacctcgggatccgtacaacaggtgaacaacactaacccaggggtggcaccacccccgcttttcacactttgtaccagtctaggggaagggaacccgccccccgaggatttgccta

SEQ ID NO: 87044 - protein, 153 aa, Zea mays
  misc_feature: Ceres CLONE 1573864
  misc_feature (46)..(78): Pfam Name: Ank Pfam Description: Ankyrin repeat
  misc_feature (79)..(111): Pfam Name: Ank Pfam Description: Ankyrin repeat
  misc_feature: SWISSPROT Homolog: EC 2.4.2.30 NAD(+) ADP-ribosyltransferase
MGHGVSCARTGDEHDYFRAAQVGDLEALEALLDADPSLARRATLYDRLSALHIAAANGRLEVLSMVLDHGVPPDVVNRHKQTPLMLAAMHGKTDCVLKLLQAGAQYPHVSDSQARGGTCPGTTAVLTSGHIRPALQAIPSRAARNQRRVGQTT

SEQ ID NO: 87045 - DNA, 799 bp, Zea mays
  misc_feature: Ceres CLONE 1573865
  misc_feature: Encodes the peptide sequence at SEQ ID NO. 87046
aagctggagctccccgcggtggcggccgctctagaactagtggatcccccgggctgcaggaattcgtctcacccctagaaaaagtgtctctccagtcttcttcacacccctgcttcctccctcttcctcttttgtttcagtcagagagaaaaaaaactagatttagcgagggcggaccgactacgcaatagaagcaaccgagacatggagcggcggaggaaggcaatgtggctgtacaccaaggtggtcggtttcaacccgccggagaggtggggccactccgcctgctgcttcgaaggcttcatctacatcttcgggggatgctgcgagcggcctgcacttcggcgacgtgctgaagctgaacgtggagaccatggctgtggagtcttgtggacactgacggggcagtgcccgggcacgcaggacagccacggcgccgcgctggtgggccaccggatgctcgtcttcgggggcaccaacggcggcaggaaggtgaacgacctgcacgtgctggacctgcacaccagggagtggacgcgcccgcagtgcaagggcgcgccgccgccgtcgccgcggaagagccacaccgtatccgtcgtcgggggagaccgcctcgtcgtcttcagctgtaccggggagggcgagggtaactacctctgcgacgtgcacgtgctggacgtgcccaccatgacctgttcttcttccgaagtcaggtgcgggcagtcgacctcgcccagggacagccagagttccgtggacatctgcacgcagatattcgtctttctgagagactgcggat

SEQ ID NO: 87046 - protein, 198 aa, Zea mays
  misc_feature: Ceres CLONE 1573865
  misc_feature (72)..(117): Pfam Name: Kelch_2 Pfam Description: Kelch motif
  misc_feature: SWISSPROT Homolog: EC 3.1.3.16 Phosphoprotein phosphatase
MERRRKAMWLYTKVVGFNPPERWGHSACCFEGFIYIFGGCCERPALRRRAEAERGDHGCGVLWTLTGQCPGTQDSHGAALVGHRMLVFGGTNGGRKVNDLHVLDLHTREWTRPQCKGAPPPSPRKSHTVSVVGGDRLVVFSCTGEGEGNYLCDVHVLDVPTMTCSSSEVRCGQSTSPRDSQSSVDICTQIFVFLRDCG

SEQ ID NO: 87047 - DNA, 792 bp, Zea mays
  misc_feature: Ceres CLONE 1573868
  misc_feature: Encodes the peptide sequence at SEQ ID NO. 87048
ggagctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgatggcgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggtcagcgcgtcctcaacactggctcccccatcaccgtgcctgttggcagggctacccttggacgcatcataaatgttattggtgaaccgattgatgagaagggtgacataaagacaacccacttcctcccctatcatcgtgatgcccctgccttttgtgagcagggcactgagcagcaaattcctgttacggaaatcaaagtccgtggatctccttgaaccctaa

SEQ ID NO: 87048 - protein, 215 aa, Zea mays
  misc_feature: Ceres CLONE 1573868
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAQAAPATPPPATGKTGGGKITDEFTGAGAIGQVCQVIGAVDGVRFDEGLPPILTALEVLDNNIRLVLEVAQHLGENMVRTIAMDGTEGLVRGQRVLNTGSPITVPVGRATLGRIINVIGEPIDEKGDIKTTHFLPYHRDAPAFCEQGTEQQIPVTEIKVRGSP

SEQ ID NO: 87049 - DNA, 1094 bp, Zea mays
  misc_feature: Ceres CLONE 1573871
  misc_feature (1)..(1): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
nggggtcgccgcgtgccgccgcctctccgcacgagccatgtaaaaaactacttatatttccctttttttnnnnnttaaagctgggactccccgcggtggcggccgctctagaactagtggatcccccgggctgcaggaattcgtctcacccctagaaaaattcaacttgcagatgctaaacatactaaacaagtgtgagagaaatactacagacatttacgaatgtcacacattttttctaatactgattcatatcatattacaagtatactctacttatatttcctttatttttagcggtggagttcaattgtatctttttaacaaaatataaggagtttcagttcagattatgcacttttcatgttctatctatctgctttgtaaactgatttaccaaaaaaactcataagataggcatgagagctataaatattcttggaataaaaggtgaggctgcatgcacttgtttggatctcatggtacgaaacgagttgttgctgctaattttccctaaaataggaaaggtaggggaaattctttctggataaaatttatattgggtagtgtccaattcccgttattttcgcggaactacggttgatgaatcccgttggttacccgccaattaaaggaattcctaacaaaaatagtaatggggcctcctttgttaatcccctttgaatttggaatggccgggggaaattttttattttaagggaaaaccctaaggggccaaaacggaaaaagggttcagggaatgtcctttttttaaaataataaaagtgcctctgtggccttcaaaatatccccagaatttgttttatggcccccattaccaatttccccgtggaatttcccggaatgatgaggtggttgggggaaaaataatcacttttgttgtgggaacccttttagtttcctcgtgggcaaattgtaagggggcgatattttattttactaacaaaaaaccggtcgtaatggaaacccccccgacgtggaagagaaaaacgcgcccatttgaaatgaggttcccttagagacaatttgaaagggcgtttttagagaaatctcgggaaaactgtctgtgctct

SEQ ID NO: 87050 - DNA, 2628 bp, Zea mays
  misc_feature: Ceres CLONE 1573876
  misc_feature: Encodes the peptide sequence at SEQ ID NO. 87051
aatctccaccgccgccgcatcagccatggcgcgccgccacctcgcctaccccctgcgcctctcgatcctctcccgcaatcccggagcccctgcccgctcgctatgcgcctcatcgtccacccacgaggtcccagtcccggccgtcgaggcccaggcggaggcggaagcggcggcgaaggctgctgcgtccccctctccgtcggcgcccgccaacccgccccggcgcgaggagcctctccacgagacggtgctgcacatgatccggcggcggccgtggacgacgcgcctggagaactcgatccgcctgctctcgcccaccctcgacgcgccgctggtccacggcgtcatctccggggccgcatccgcggggcgcgccgacctcgcgctccagttcttccgcttcgcataccgccggggcgggttcagcccggagggcgccacgttcgcgctcctcgtgcccgcgctcgcgtcgcgccgcatgctcaaccacgcgcgctgcctcgtcctcgacaccatgccgtccttctccgtcgcgcccgacgagcccacgctcgccgcgctcatctccgcctacggcagggccgccatcccgcaggaggccgttaagctgttccggatgatgcccaacataggcgtcccccgcacggcgctctcctacaacgccgtactcaaggccatactctgccgcggacgcgaggccatggccaggcggatctacaacgccatgatcgcggacggggtggcgccggacgtgtccacctacaacacgctcatctgggggttcggcctgtgcaagaagatggagaccgcagtcagggtgtttggggacatgaagggccatggggtgacccctgatgtcaccacctacaacaccctgctgaacgcctgggtgcgtgccggtgatctggagagtgcgcgcaaggtgtttgatgaaatggctggggaggggaccgagcggaactcggtctcgtacaatgtcatgatcaaggggtacgtggaaggcaatagggtggaagaggcagtggcgttgttcgctgagatggctgagaaaggattgaggctgagtgagaagacatttgctgcgttgatgccagggctttgcgatgaccagggcagggtggcagaggcccggaaggcagtggatgacatggcagagcggaggctcacgccaaaggacaagtcagtgtttctgaggcttgtcacaacgctgtgcaaggctggtgacttggatggggcgctcgaggtgcactggaagagcgggcagttcaagcatgtgctggtggatccaagacagtatggggtgctgatggaaggcctttgcgctggcggcaagtgcgagactgctattgaggtgctagatgagcttatggagaagggcaccttgctgagcccaaagagtcctgtgcttgaagcatcggcttataacccggtgatcgagttcctgtgcagcaatggtagcaccgccaaggccgagacattcttcaggcagctgatgaagaaaggtgtggatgacaaggctgcattcaacagtctcatccgtggacatgcaaaagaaggtgtgccagaggcagctcaggagattctcgccatcatgacacgccgcgaggtcccaactgaccctgaatcacatgcgctgctagttgatagcttcctgaagaagaatgagccggctgatgcaaagacggcattagacagcatgatgcaacagggtcacttgccaagcccagctctgttcaagtctgtcatggaggcgctgttcaacgatggccgggttcagaccgcaagcagggtcatgaagagtatgattgagaagggagttactgagaacatggatgtggcacacaagatactggaagctctattcacgaggggccatgtcgaggaggcaatcggccgtgtcaatctgatggtggaaaatggctgcatgcctgatctggataagttgctggtcggcctatgtgacaatggtagagtgatggaggcgcagaagctggctgattttgcgttggacagggactttgatgttagcttctcgacctatgacagagttctggaggccctgtacgccgaagaaaagacgttgcctgcgtactccatgctgtgcaagatcaagaacaaaggaggtgttgtcagccagaaaggctgcgatgacttgatggagagcttaaaatccgaaggatactcaaagcaagcagatattctgtctaggatcttggcagagaatgcacagtcgacgcccaagaggggcagaagggttgccatgggtgcttagtgagctttgccagcttgtttagagcatctgtgttgttgttgttttacttcaagaaagatgtgatttctttcttttcatcgatgcttcttgagctatttatcaagtgggggattttggtcctatgggacgataagcaagggcgtttactttctgtttggaggatccctgatctgttcgtcttggcgagaagaaacatatgcaataataggcaaagatgtacctcctattatgagtggtgttgtcaaatttagaattaattacttttaacatactgcacttccaacatttttaccaatgacattttggattgaggctaatggagttactctttgctttaaaaaaaaaaaaaaaaaaaa

SEQ ID NO: 87051 - protein, 748 aa, Zea mays
  misc_feature: Ceres CLONE 1573876
  misc_feature (314)..(348): Pfam Name: PPR Pfam Description: PPR repeat
  misc_feature (244)..(278): Pfam Name: PPR Pfam Description: PPR repeat
  misc_feature (279)..(313): Pfam Name: PPR Pfam Description: PPR repeat
MARRHLAYPLRLSILSRNPGAPARSLCASSSTHEVPVPAVEAQAEAEAAAKAAASPSPSAPANPPRREEPLHETVLHMIRRRPWTTRLENSIRLLSPTLDAPLVHGVISGAASAGRADLALQFFRFAYRRGGFSPEGATFALLVPALASRRMLNHARCLVLDTMPSFSVAPDEPTLAALISAYGRAAIPQEAVKLFRMMPNIGVPRTALSYNAVLKAILCRGREAMARRIYNAMIADGVAPDVSTYNTLIWGFGLCKKMETAVRVFGDMKGHGVTPDVTTYNTLLNAWVRAGDLESARKVFDEMAGEGTERNSVSYNVMIKGYVEGNRVEEAVALFAEMAEKGLRLSEKTFAALMPGLCDDQGRVAEARKAVDDMAERRLTPKDKSVFLRLVTTLCKAGDLDGALEVHWKSGQFKHVLVDPRQYGVLMEGLCAGGKCETAIEVLDELMEKGTLLSPKSPVLEASAYNPVIEFLCSNGSTAKAETFFRQLMKKGVDDKAAFNSLIRGHAKEGVPEAAQEILAIMTRREVPTDPESHALLVDSFLKKNEPADAKTALDSMMQQGHLPSPALFKSVMEALFNDGRVQTASRVMKSMIEKGVTENMDVAHKILEALFTRGHVEEAIGRVNLMVENGCMPDLDKLLVGLCDNGRVMEAQKLADFALDRDFDVSFSTYDRVLEALYAEEKTLPAYSMLCKIKNKGGVVSQKGCDDLMESLKSEGYSKQADILSRILAENAQSTPKRGRRVAMGA

SEQ ID NO: 87052 - DNA, 829 bp, Zea mays
  misc_feature: Ceres CLONE 1573878
  misc_feature: Encodes the peptide sequence at SEQ ID NO. 87053
  misc_feature (328)..(328): n is a, c, t, g, unknown, or other
ctccccgcggtggcggccgctctagaactagtggatcccccgggctgcaggaattcgtctcacccctagaaaaagcggtcgcgcaggcgtaccaaacagctagggccgggggccgcagccgcgcacacagcaagcaatggcggacgccgccgagatggtgcgcttcctctatctccggaccccgccgcggccgttgctcccgcagttcgctgtacatacacagcggccacaaagtctgctcagagtttccccccgcttccgccctcccatccgtcttcggtgccgcgcgctcgacgccagtagaccggttgcggtggagggggagcgnggatgaggaggacggtctcgaggacgaggaggagtcctacttctcggtcacctcgtcggggctctcggaggtggactacctaggggaaagcaccaggggggatttgaacgtgaggagggagcgcctcgaggcgcttgggaacagcaagtcaactttgcatggtcctattgaggagatagcttggaaagaagcgggagaagctgaaacattgcttcatgacttgggaattgcagacccgttttcagtaagacactctcctcgtggaattttctgcaccaggacactaaatcttcgatctatcagtgtagttggctacgatatggattatacattaattccttacacaatgtgatgggcttgggaaagacgtgcatatgactatgggatggacaacctcaagagcatggggttttccagtagatgaactttaaatttgaccctgacctggtcaatagaagtctttgttaattgataagaagaagaaaacttgtgtaaaagcta

SEQ ID NO: 87053 - protein, 225 aa, Zea mays
  misc_feature: Ceres CLONE 1573878
  misc_feature (109)..(109): Xaa is any aa, unknown, or other
PRGGGRSRTSGSPGLQEFVSPLEKAVAQAYQTARAGGRSRAHSKQWRTPPRWCASSISGPRRGRCSRSSLYIHSGHKVCSEFPPASALPSVFGAARSTPVDRLRWRGSXDEEDGLEDEEESYFSVTSSGLSEVDYLGESTRGDLNVRRERLEALGNSKSTLHGPIEEIAWKEAGEAETLLHDLGIADPFSVRHSPRGIFCTRTLNLRSISVVGYDMDYTLIPYTM

SEQ ID NO: 87054 - DNA, 822 bp, Zea mays
  misc_feature: Ceres CLONE 1573879
  misc_feature: Encodes the peptide sequence at SEQ ID NO. 87055
tggagctccccgcggtggcggccgctctagaactagtggatcccccgggctgcaggaattcgtctcacccctagaaaaacttggtttcctcctctatctctcgtctccctccgaccgaattaaaacgctcgacctgccaagccggactgaaccctaggccccgatccggcgtctcgccgtgctgcttggatttgatcgggcggggttggggtcgtatcggcggcgggatgaccatcccgagcgcggaggggttcctccaggcgtcgagctgcctcccgtgcacggcgacggaggagcgggaggtcgttgacgcgcttaccaaggaggccgagaagaatgtcaagcacggcgatctccgctatctcgtctcgcagagctggtggatggagtggcaaggatatgtgggtctagtcaattatggagaaagtggcaccgagcagtttcctcaggccacaaatagacctggagagattgataactcgaagcttgttttggcagaaaggatcaatggtagtgaggagccagagcttcaaaggaccttgagagaaggggagcactatactttggtgccgcaagaagtttggcaaaggctatatgaatggtataaaggtggaccagaaatccctagaaaaagtatttttgacaatccaactgacaagacttacgtagtggatgtctaccctctctgtctaaactaattgatgcaagggacgactctgagaaagtttttagataagtagaaaagccaaagttcatgagctttactcaatgtttgctcgctcatgtcagtagagcagtctgagattgtcatcggggattatt

SEQ ID NO: 87055 - protein, 156 aa, Zea mays
  misc_feature: Ceres CLONE 1573879
  misc_feature (100)..(156): Pfam Name: DUF1055 Pfam Description: Domain of Unknown Function (DUF1055)
  misc_feature: SWISSPROT Homolog: EC 3.1.2.15 Ubiquitin thiolesterase
MTIPSAEGFLQASSCLPCTATEEREVVDALTKEAEKNVKHGDLRYLVSQSWWMEWQGYVGLVNYGESGTEQFPQATNRPGEIDNSKLVLAERINGSEEPELQRTLREGEHYTLVPQEVWQRLYEWYKGGPEIPRKSIFDNPTDKTYVVDVYPLCLN

SEQ ID NO: 87056 - DNA, 870 bp, Zea mays
  misc_feature: Ceres CLONE 1573881
  misc_feature: Encodes the peptide sequence at SEQ ID NO. 87057
ctggagctcaccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgcgttgttgagtgatggtggtgtccactcccgccttgaccaactgcagttacttctgaaaggtgtcagtgagagaggagcaaaacaaattcgtgtgcacatcctttaccgatgggcgtggacgttttggatggcagcagtggttggtttcgatggacgacccttagagaatgatgcttttgggagctacgaagacaacgggtatttgatggcaacagattgctttctgggtggttggaaaggatgtattgttaccatggaccgtttgacatactggatgtggtaacctggctggaagccaggggctgtaagaacacctacatttaat

SEQ ID NO: 87057 - protein, 222 aa, Zea mays
  misc_feature: Ceres CLONE 1573881
  misc_feature (15)..(215): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIALLSDGGVHSRLDQLQLLLKGVSERGAKQIRVHILYRWAWTFWMAAVVGFDGRPLENDAFGSYEDNGYLMATDCFLGGWKGCIVTMDRLTYWMW

SEQ ID NO: 87058 - DNA, 873 bp, Zea mays
  misc_feature: Ceres CLONE 1573883
caccgcggtggcggccgctctagaactagtggatcccccgggctgcaggaattcgtctcacccctagaaaaagcctgctcctatccaatgctgcccaagcaaccgcaccagccacagcatcactgacagtggaccaaagcataggtgctcctagtgctctctcatcacttccccctctgccacctcgtcctcaccctggtcggtgcccttcccaccaggctacactaccttcccgaccgattctctgcgcagctccgctcacctgttcctgacaatggctggatccggcaatgttcttgaccagatgcgagtgcaagtgcgtaattgtgtgctctgcttctttcggtttccgcggataggacaagctgcggcctgatgatcctgctacagcatgtgctggcgattctttgttttgggagttctggcatggtgtgtgttaagccgatcggcaacagagatctttttgtggtgaggtggtattactagcttccatcgagcattctatgcaaagagttctgaaggccttcacctatctagcaactctgatcaaacactctacctctggttctgactgtacccatccaatgatttctctggactggctgcgtcaacagtggcaaaccttctagcaaataacctgtacgcctcatcaaactgccatagctccaagattgtgcctggccaccacaaaacacaatctatagttgggctttatcaaaacacggatttctggagtgtatttgtatggcaaaaaagcaggccgtcctacataattccatcttgccaaaacattttgcctgtttttaaaaaaacttaataacctccaaagaagaacctctctttttttccccagaaagaagttagctgtcaaga

SEQ ID NO: 87059 - DNA, 972 bp, Zea mays
  misc_feature: Ceres CLONE 1573886
  misc_feature: Encodes the peptide sequence at SEQ ID NO. 87060
  misc_feature (16)..(16): n is a, c, t, g, unknown, or other
  misc_feature (17)..(17): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
aacattttaacccttnnactttactccatgtaaagctaatgccagaacatagaggagaattcctcgnnnnnnnnnaaaaaactggaactcccgtcggtggcggccgctctagaatagtggatcccccgggctgcaggaattcgtctcacccctagaaaaaatccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctactttcgtggccttacgtagcaggggcagacgctcgtggcctccctcaaggagatcagggccgccaacgtttctcggtccggcgaatactgtttacatacggggggcccccgtgggggaaaacaaggtttcgggcttccctgttcaacgcgaaccctggcttgcctggctgcgccggcgaacgggccaagggaatccctgggggtccgccgggccatgggtgggcgaaccggaagaataattcttccaaaggaagggcccattcctctcgtccgcattgagttcccttggtctccccccacctggggacaaaacagcctttaaccgcgaaaagaaaaggaaagccttggaaaga

SEQ ID NO: 87060 - protein, 127 aa, Zea mays
  misc_feature: Ceres CLONE 1573886
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFRGLT

SEQ ID NO: 87061 - DNA, 865 bp, Zea mays
  misc_feature: Ceres CLONE 1573890
  misc_feature: Encodes the peptide sequence at SEQ ID NO. 87062
  misc_feature (734)..(734): n is a, c, t, g, unknown, or other
  misc_feature (865)..(865): n is a, c, t, g, unknown, or other
tggagctccccgcggtggcggccgctctagaactagtggatcccccgggctgcaggaattcgtctcacccctagaaaaatgtcatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatccctccaagagtgcaaacgctagggaccagattctttctggtacggagaatgtgactacaggcaatgcacgcggcggcagctccttgaaatcgcaaaaaggcccggccagagaaggctagctctgtcggaaaacctggagaacaaccttttccctaccatcaaaatgtgtatgcaccacagccacaacccactctatcctggaggctacatgaacccttcatgacaatgggaggaatatccccattatgtgagtatggaggggctccattcccgtatctcccgggatctacaatgacaaccagttcctcatgctatctcctgaatatgcaaaacattccccaaatgatgtatggaagcatattctccctgtttcccacggttgggggatgggccaacaanaaacctccctaatgcattttttcccttccccaagtcccttactatctaaccaccagccttctccctagccaggggaatattccaagcttctggcgactgggaattatccccaagggaaacccttatggctn

SEQ ID NO: 87062 - protein, 66 aa, Zea mays
  misc_feature: Ceres CLONE 1573890
MAAAPHQAQGPADSVIPLQSEPALDNNPSKSANARDQILSGTENVTTGNARGGSSLKSQKGPAREG

SEQ ID NO: 87063 - DNA, 833 bp, Zea mays
  misc_feature: Ceres CLONE 1573893
  misc_feature: Encodes the peptide sequence at SEQ ID NO. 87064
  misc_feature (610)..(610): n is a, c, t, g, unknown, or other
ctggagctccccgcggtggcggccgctctagaactagtggatcccccgggctgcaggaattcgtctcacccctagaaaaaaggtcgccaaaatcaaaccacctctgcgactgtgaatgaaatgaacacacaaaccaagttaccaaagtttacataaacaaaaaaatagttagcacgattatattgtactgtaaccagacccagtgcaccgcgagcgactgatgcgcccagaggagccgaagctttcggcgcgcctataaaagcatccagccagctcgcgcctcctccacaacccctgtctgtgggagaagggaggagccagagccagccagccagccaccgcccacggcggccacacaacctcggtcggcgcggcggctcaacccaatggctccttcctccccccgccgcccgctgcgccaccacccgtctcccctcgtcgtcctcgccgtcgccgtcctcctcgtctcgctccgaatctcgcgcaccgccgatgggctgccggaggcgggaggaggaggaggcgacggtctgtaccgggagattctcagagacgagaccgtgcagaggctcaaggagctgggcaagatatctgatggggatggctaccnttgaaggacgtttctgagtccggcttctatcagagccactggtgtcatcgtcagctggatgaaagacgctgggcttacgacgtgggtcgatcagatggggaaatatcatggtcgatatgagccggcaaattctaccagagatgccttgttgattggatctcatatggacactgtcgttgatgctgggatgtacgatggaagctttgggtattatttcagccaa

SEQ ID NO: 87064 - protein, 74 aa, Zea mays
  misc_feature: Ceres CLONE 1573893
MAPSSPRRPLRHHPSPLVVLAVAVLLVSLRISRTADGLPEAGGGGGDGLYREILRDETVQRLKELGKISDGDGY

SEQ ID NO: 87065 - DNA, 972 bp, Zea mays
  misc_feature: Ceres CLONE 1573894
  misc_feature: Encodes the peptide sequence at SEQ ID NO. 87066
tccccgcggtggcggccgctctagaactagtggatcccccgggctgcaggaattcgtctcacccctagaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgtttgtacgtgcggcgcacgcggcgtgaatatacgtacatgcctgaacccagaaacccgggggaagaggctggggaagaacccaaacattcttcccgggggaaaggggcatttccccgggggcgaaccctgggagggccaaggggggggtgacaaccctctgtcaataaaacgtcggtaaaacgggggggccaagttacaacgcccccccccctttcccctggggacgcgggaattccgccccaaaaaaaagaaaatttgggggtggggcgcgaaacagggcgcccgaagaatttccgtgagagcccactaattgtccccccccccccagagcccccgggggggggggggtgttgaacaaaagaaaacccccggggtttttccccccctccccagcggggggtcacggaagaagagggccccccctcctgggggtgtgggggaaccctcgccacaaagaatttcccccgtggggttctggaggggccccacccttggattatggggggggggcgcctatttttattcgcgccccccggggggaggagaaaaaaaaactaccccccctttttttgtccagaacccctccttggaaaaaaaaactccccgttgttacccctgtggggaaggggggggggtggagtaaaaaccccttttattgtgtttcttccggggggggggaaaaagaagaagggggggggtcgcaca

SEQ ID NO: 87066 - protein, 93 aa, Zea mays
  misc_feature: Ceres CLONE 1573894
MASSSSSRLLLLLLPCLALTLLGAADAEVHHHEFVCTCGARGVNIRTCLNPETRGKRLGKNPNILPGGKGHFPGGEPWEGQGGGDNPLSIKRR

SEQ ID NO: 87067 - DNA, 827 bp, Zea mays
  misc_feature: Ceres CLONE 1573901
ggagctcaccgcggtggcggccgctctagaactagtggatcccccgggctgcaggaattcgtctcacccctagaaaaagtctcgctttcctgtcccgttcaccccaagcccccaagctgcgagctgcgacaagttcgtctctctcgtggccacgactggtcgccgcccccgcctccgtcctctcccagattctcaggtcttcgccgctcccttcgccgccaaagagcacccactaggttacaatccgccagggggaaatctccatcaagtgggtcgtgctaattatgcgatcttcatgggatgactcagttgcgaacgccgaggaatcgcgcggccgcgactgctgctgctaatggctctgttgcaactcataggacctcccgccctacgcgcagctcctacgtgcctcgcacatctacgtggccgtctcagctggtgctgctgttaaagctcacgcaggcttagtagcaccagcacaaggtggatcactgccattggctgctgcacaaccttctggtaaggctgctgctgttggatgggcctcgctgggctggcattgagaatgctgcaggtggagctgccaacatagatggtcctcgccagggccatggtggccgaagcgaggggccctgctccttggaactccggttcctggtggttggggaccttaaaagacccggaagcccagaacccgttttgccaaaaggcccaaggctggaagaaacttgaattttctaacgggccaaggaaaaatatccggggacttcaagtttttgaatgcccctattaaaggaaaatccccctggttgggaggaacacaggtgggg

SEQ ID NO: 87068 - DNA, 822 bp, Zea mays
  misc_feature: Ceres CLONE 1573904
  misc_feature: Encodes the peptide sequence at SEQ ID NO. 87069
  misc_feature (703)..(703): n is a, c, t, g, unknown, or other
  misc_feature (712)..(712): n is a, c, t, g, unknown, or other
ggagctccccgcggtggcggccgctctagaactagtggatcccccgggctgcaggaattcgtctcacccctagaaaaaatcccagcacgtctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatgcccctgtacgagaagtacggcgagaacttcgtggacatgctggacggggtgttcgcgttcgtgctctacgacacccgcgacaggacctacgtggcggcgcgcgacgccatcggcgtcaacccgctctacatcggctggggcagtgacggttccgtctggatcgcgtccgagatgaaggcgctgaacgaggactgcgtgcgctttcgagatcttcccgccgggcccactctacntcagcgccnggcggcggggtcccggcggtgggtacacccccgcactggttcccagaagcaaggtgccccgggaccccttaccaagccgcttgtcctccaagaggcgcttccaagaagga

SEQ ID NO: 87069 - protein, 221 aa, Zea mays
  misc_feature: Ceres CLONE 1573904
  misc_feature (2)..(162): Pfam Name: GATase_2 Pfam Description: Glutamine amidotransferases class-II
  misc_feature: SWISSPROT Homolog: EC 6.3.5.4 Asparagine synthase (glutamine-hydrolyzing)
  misc_feature (182)..(182): Xaa is any aa, unknown, or other
  misc_feature (185)..(185): Xaa is any aa, unknown, or other
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFRDLPAGPTLXQRXAAGSRRWVHPRTGSQKQGAPGPLTKPLVLQEALPRR

SEQ ID NO: 87070 - DNA, 786 bp, Zea mays
  misc_feature: Ceres CLONE 1573907
  misc_feature: Encodes the peptide sequence at SEQ ID NO. 87071
tggagctccccgcggtggcggccgctctagaactagtggatcccccgggctgcaggaattcgtctcacccctagaaaaagtcagatcttgtaaagagagttcggacgacggcgccagccggcaatggcagtgacaatgcaccgccagggccacattgcgcagtgccttggtatgatcctcgtctgccatggcagcgccaccgccgccgtcgctgctggcccaggcggacgacagctcaccggcgcgtagttcgtccaccgcgtgcagagcctggccgctggcgtcggataccgcgaggtgcgccctggacacatcttcaccgccgtcaccctcaacagcgtctagtacgtgcagctgttcctcgacatcacctacaccggagacatcatcagcaccctctcaactaccgctggagcttcgaggaggccgcacaggcggtggagctcgtgcaggcaacagatttcgccttcgacaggcgcgttcagctcctgggcgcttcggctgatggagggtgacaggttcccatccatcggcctctacctcctcctgggcgatccttgcaggaccggacgcgctgctgcaggttgtgctgtacccattgcctacgtcacagggagcctcctctgatctacagccgcggctgctatggagcccatatccgctccagacgacatagctctaatatgcttcacatccggaaacacaaaggcagcccaagggcatatcaataagccacacgtcctttgatagaacagtcccttctcaagatcagcagtgtactgctat

SEQ ID NO: 87071 - protein, 40 aa, Zea mays
  misc_feature: Ceres CLONE 1573907
MEGDRFPSIGLYLLLGDPCRTGRAAAGCAVPIAYVTGSLL

SEQ ID NO: 87072 - DNA, 1158 bp, Zea mays
  misc_feature: Ceres CLONE 1573910
  misc_feature: Encodes the peptide sequence at SEQ ID NO. 87073
  misc_feature (69)..(69): n is a, c, t, g, unknown, or other
  misc_feature (70)..(70): n is a, c, t, g, unknown, or other
cccctttaccctctgtgaattgtcgctctatatttttgcgagtgcgtgtggtggcgggttaaacccatnnaataacaatgatggagctccccgcggtggcggccgctctagaactagtggatcccccgggctgcaggaattcgtctcacccctagaaaaatccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacaacgccgggggcggcaagaagcccaaggagccgaagcagaagaagggtaagaagccgaaccccttctcgatcgattacaaccgctcggggcaggcgagcgcgccaaagctggtggtgctgcgggatcccacggggcgggatatcgcggcgcggtactagctcggcacagagctcgggcgcggcgagttcggggttaccctacctctgcaacaaaccgttgcctcagggggaaggcgctgggcgtgcaagtattatctcccaagaagaaaggctccgcacccgcccgttctaccctcgaaagaaccatggcgcccggggaaaggtgggaagaattaattgggccccaagccgtcgccccaaggagtccccccccaaatcggttccggttcaaacggacatctcttgggggaacgaaccctttaatcctcaaagggcaccgcaaacttaattggcgcccgggtggggccaccccctctccagttatacatggagaaaacctccttctctgccctcagaaggggccccgtgtgtgaaacactttctcttttcgggagactcggccaatttctcgatggtgcctggacgcgggggaaaacaaactctaacacactttgtaaaaggtgagagtgcctggcgcacagcccgctttgggtgtgtcctaaacgagacaccgtttttatccggtttggtatagggccgtcctgggtaacagaaagtagtgcccaccagtaaaatcacctttgaggagagttcgcattcaccaaccagggggctatatccttctagaaacccgggcagaaaatattctctcttgg

SEQ ID NO: 87073 - protein, 64 aa, Zea mays
  misc_feature: Ceres CLONE 1573910
MGNCCVTPKAADNAGGGKKPKEPKQKKGKKPNPFSIDYNRSGQASAPKLVVLRDPTGRDIAARY

SEQ ID NO: 87074 - DNA, 816 bp, Zea mays
  misc_feature: Ceres CLONE 1573916
  misc_feature: Encodes the peptide sequence at SEQ ID NO. 87075
  misc_feature (644)..(644): n is a, c, t, g, unknown, or other
  misc_feature (777)..(777): n is a, c, t, g, unknown, or other
tggagctccccgcggtggcggccgctctagaactagtggatcccccgggctgcaggaattcgtctcacccctagaaaaagctcttgtcttcagaagtttcagatcctcgcatcgtccgcaccttatcctctcgactttacagtacctgctctcagctcctccctatctcaatggcatccgcgaatgccatctccaccgcctcccccttccggcccctctctcagggcagggcgacgaggtcacagcggttcgtggtgcgtgcgaacgccaaagacattgcctttgaccagaaatccagggcagcgctgcaggccggcgtcgagaagctcgcaaacgccgtcggtgtcaccctcgggccacgagggaggtatgtggtgctcgatgagtacggcaaccccaaagttgtgaatgatggagtcactattgcccgtgctattgagctgtatgatccaatggaaaatgctggtgcagcattgattcgtgaggttgctagcaagaccaatgattcagctggtgatgggactacaactgcatgcgtccttgctcgtgaaatcatcaagctaggccttctgagtgtaacatctggtgcaaatcctgtatcactaaagaaaggaatagacaaaactgtgcagggcctaaatcangagcttgagaataagtctagaccaatcaagggtggtggtgatatcaaagctgttgcatctatctctgctggcaatgatgaaattatcgggatcatgattgctgaagcaatggaaaaagtgggggctgatggtngtctatccaatgaatccctcctccgtcttttgaaaccac

SEQ ID NO: 87075 - protein, 215 aa, Zea mays
  misc_feature: Ceres CLONE 1573916
  misc_feature (158)..(158): Xaa is any aa, unknown, or other
  misc_feature (203)..(203): Xaa is any aa, unknown, or other
MASANAISTASPFRPLSQGRATRSQRFVVRANAKDIAFDQKSRAALQAGVEKLANAVGVTLGPRGRYVVLDEYGNPKVVNDGVTIARAIELYDPMENAGAALIREVASKTNDSAGDGTTTACVLAREIIKLGLLSVTSGANPVSLKKGIDKTVQGLNXELENKSRPIKGGGDIKAVASISAGNDEIIGIMIAEAMEKVGADGXLSNESLLRLLKP

SEQ ID NO: 87076 - DNA, 844 bp, Zea mays
  misc_feature: Ceres CLONE 1573917
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (488)..(488): n is a, c, t, g, unknown, or other
ggagctccccgcggtggcggccgctctagaactagtggatcccccgggctgcaggaattcgtctcacccctagaaaaattttcttccggcgtggccaagggaggtgccgagtctgtaccagtacgacgactcaggccagaacacacggcgtatggtatggtacacagcaaggccgtgttgttgctgtaagttttgtaatttctgtttcctgctcggcttcgcagcatgcagttgctgtatatgatggaagaacactctgttactgggcatgttgcgcggtttccacgcgtgtaagtaatgtagaagtcgctatggtaggtatttccataccgtcattagtggatcattgattttttttgtaagaaggttattgcaatgccctttttccgggcatgaataagaaaaaggaaatatgcttnnnnnnnnnnannnnnnnnnnnnnnnnnnnnnnnnnnnnnnnnnnnnnnnnnnnnnnnnnnnnnnnnaanaaaaaaaaaaaaattcccggggggcggcggcgaaaaaataaacaaaaaaggggggccccaaaaagggtccccccccttaaagtttgccccaggggggaggcttaacccccttcgtttcccccccgtggctttccgggcaaaccttttcttgaaaattggggcccccccgtccccttttttgttaacccggccgaaaacccccccctttggggccccaagccccctcctaatttttggaaccccgggaggggttccctttttcccactatcgggggggggtaaaaccccggtggcccccccaaattttcccccgggcaaaccccccaattttttcggggcccctttcctaggattag

SEQ ID NO: 87077 - DNA, 805 bp, Zea mays
  misc_feature: Ceres CLONE 1573918
  misc_feature: Encodes the peptide sequence at SEQ ID NO. 87078
gagctcaccgcggtggcggccgctctagaactagtggatcccccgggctgcaggaattcgtctcacccctagaaaaaacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatgttgagaagcacgtcgctgaggctgacatcatcttcgtctcggtgaacacccccaccaagacccgtgggctttgaagctggcaagggctgccgacctcacctactgggaagagcgctgctcgtatgatcgccgatgtctccaaattctgaacaagatcgtttgtccaaaaagtccaccggtccctggtcaagaaccgctgaaggcttattgaagaaaatctttgacccacaaccagcgagggggcttcaaactacccagaattcctttcccaacccccggagttttccttgccagaagggggcccgtcttttttgttggaagg

SEQ ID NO: 87078 - protein, 95 aa, Zea mays
  misc_feature: Ceres CLONE 1573918
  misc_feature (2)..(96): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGL

SEQ ID NO: 87079 - DNA, 853 bp, Zea mays
  misc_feature: Ceres CLONE 1573929
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
ggagctcaccgcggtggcggccgctctagaactagtggatcccccgggctgcaggaattcgtctcacccctagaaaaagtttttctgatgagagtttcctgccgccggcagggtctactcttcccatgttgtagctgcatcgggaccccctgaagatcatggaacaaatcccacaatgtgctcatctcaaatacgacgcgaaatttttcggcacgcgtgacggcgaggaaattggtgcgctttcagctgctgttccgtgctcacggatttggaaggccagatcattggcggttactaagggtgaatgttgtggatattcgctcaaatttggattttgggtgtaggatgccgagcaggagatctgtgtgtgccccccgaagacatgaacgcggatgtggcgacgcgcattagagggtcaccgacaacctgctgatgagccactattgcgcggggaatatcgagctctgcgacatcatcaacgaggatccatgacaagcaaaggatgacgtgccagtcctaaagaaacgtcttgcgggcaagaatactgaagtgcagattataactctttatgtgctagagactctagagtaagattgcggggatatcgctcagctacagatagttgaggacgacatattgagtaaaatcgctaacatattcaagaagaaacgggtagtgagggttctgagaaaaaaattgagaaatggcatgacgtctgagctcgtatgacgcctggttcagacggactgttattcccttagaataactttctcaaaatgtttgccgcttaatcagggggttccctggtaatttatttttcaccctctgtgtattaaagatatttaggggnnnt

SEQ ID NO: 87080 - DNA, 814 bp, Zea mays
  misc_feature: Ceres CLONE 1573936
  misc_feature: Encodes the peptide sequence at SEQ ID NO. 87081
ctggagctccccgcggtggcggccgctctagaactagtggatcccccgggctgcaggaattcgtctcacccctagaaaaagtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgtcttccccccttttccctccctcgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcccaagttgagtattaacagactcgggcggttcgtgtcgctgggcgctcggaggccaccggccgacgacgacgaccacagcactggcaaatacagcagcagctcctgcaacaatggcagccctcagatggcattccatcatggcagcaactcctcctatccctggcacccgcagtgccgccaggccgccgatccatcacgcgatgcagtggagcttagagatctccctcgcaaggtcatgtgggagctgccgaagttcgggaaaatagtggaggtgggggcctcgggacgggctggaaaacgaaaaagggaacgtcccgggcggtcggtgaagattaagctgaa

SEQ ID NO: 87081 - protein, 127 aa, Zea mays
  misc_feature: Ceres CLONE 1573936
MSSLEEPLGLGDLPKLSINRLGRFVSLGARRPPADDDDHSTGKYSSSSCNNGSPQMAFHHGSNSSYPWHPQCRQAADPSRDAVELRDLPRKVMWELPKFGKIVEVGASGRAGKRKRERPGRSVKIKL

SEQ ID NO: 87082 - DNA, 1190 bp, Zea mays
  misc_feature: Ceres CLONE 1573939
  misc_feature: Encodes the peptide sequence at SEQ ID NO. 87083
  misc_feature (13)..(13): n is a, c, t, g, unknown, or other
  misc_feature (16)..(16): n is a, c, t, g, unknown, or other
  misc_feature (18)..(18): n is a, c, t, g, unknown, or other
tttatttttttgnatncncttccttatgtatcgtatcttattgtgggaaaaagaaaaggaagattccccgttaaattaagctggagctccccgcggtggcggccgctctagactagtggatcccccgggctgcaggaattcgtctcacccctagaaaaagatgactttgaaaagaaaggcacttctgatcctgtggtttatcagctagttcgggttgaaggtgatggaacacttgttcctgctacagaggatgatgttttgcagtttgaacatttccttcacaacgagaaggttgatcttcctcctattgaagatgcagaccatgtggaagagtttttcaacaatgactgcatgttactgaagaagcctgacttggaagatggatcttccaaattggagactgtggaagcacacacacaaaaattgggtgccaacttagagggaaaacatattacagtcattggatgattcccttagtcctccctcagactttagaattcatagtccagcatttcagataaattgctttaccagaacaagggggcaaaacgtcactcgaacagggaacaaatggctttccaccttgaaacctacaaaaatcggacaggtggttaaaaatgaactccttggcctgtgccttaaaaaaataataaaggggttgaatggccccttggccccaaagaatatcttgttaatgccgaaaccccaattccttaccgggaatcccccctccctgggtttttccgcgagagagggttaaaaattgagtttttcaccatgtgtccccccgtgaaaatttttatttctcccccccttttatttaaaggcaaaaggggagagaaaagagctcctcgggtttttgtgggaaaattggaaaccttctttccctaatttttaggggaaagaaatcttttcccgtggggagagcggtctgttttaagaaacgcccaccacccttttggagggccccggcgcatataaccttaatgttgttccaaagcggacgcaaggaatatgtgggggctcccaaaaaagaaagcgggaattttccccattggtgggcccttgtaaattaaatatccccctcccgaaaggtttcccaaaggttttcagggttttggtgagatattctaaaagaaactcatccaaaattgtttttgcgcaaggaatccccccaaaatatttttatt

SEQ ID NO: 87083 - protein, 38 aa, Zea mays
  misc_feature: Ceres CLONE 1573939
MLLKKPDLEDGSSKLETVEAHTQKLGANLEGKHITVIG

SEQ ID NO: 87084 - DNA, 1141 bp, Zea mays
  misc_feature: Ceres CLONE 1573940
  misc_feature: Encodes the peptide sequence at SEQ ID NO. 87085
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (91)..(91): n is a, c, t, g, unknown, or other
  misc_feature (787)..(787): n is a, c, t, g, unknown, or other
  misc_feature (1141)..(1141): n is a, c, t, g, unknown, or other
atttattgtcgcatgccgcgagtgaaggaggacgaagacaagtcaaaataacggtgtgggagagcganttnncccaagctggagctcaccncggtggcggccgctctagaactagtggatcccccgggctgcaggaattcgtctcacccctagaaaaagaggcaacgacccgcccctgccccgcctcgcgatccccacccgcggcggcgcggagggccggaatccaaaccctaaccctagcggcccgggcgccgcctccggtcccgcccgcccgccgcgccgggccgcgatggggcagtgctacgggaaggcgcgcggcgcgtcctcgcgggcggaccacgacgccgacccctcgggggcggggtcggtcgcgccgccatccccgctgccggccaacggcgcgccgctgcccgccacgcccaggcgccacaagtccggatccaccacgccggtgcaccaccaccaggcgggcgaacgcccggcgcccgcccgccttgggccctagccccggtacccgggcgggcgggcgccagccccggttcccccggggggcggtgtccgccggttcgccgggccccgggtcccacgccccccggaaagggtttctttaaaaggggggccctttttccccgaccggccccctttggccccggtgccaagggtaaaattctcaaggggcccccccgccttttgtgccaaaaagggcgccctcctttggggcgggggggggggccacaaacaccccccaaaagggggagagggggcgacccccctcatatatcctccnataaaaaaaaaaagggggcccgcagctccccccggggggggcgcccccgcgggggaccccccggaggggtctctggggctcccccggggggggccggcgcgcccttttttgtgtggtgcaccccctccccaaattttcctcccctccgagaaggggagccaacccaccggcccctctgtttgggagaaaacaaaaaaaaattttcagggggttttctcgccacaagaaaaatatatttgtgtggggggccacaaaaaataaaaaattctttcgtgaaaaaaagaaagctatcctcaggagagaggcctaccacctttttgggaatcaaactcacgggtgccctctctcccgagn

SEQ ID NO: 87085 - protein, 71 aa, Zea mays
  misc_feature: Ceres CLONE 1573940
MGQCYGKARGASSRADHDADPSGAGSVAPPSPLPANGAPLPATPRRHKSGSTTPVHHHQAGERPAPARLGP

SEQ ID NO: 87086 - DNA, 879 bp, Zea mays
  misc_feature: Ceres CLONE 1573941
  misc_feature: Translation starting site: 352
  misc_feature: SWISSPROT Homolog: EC 1.1.1.40 Malate dehydrogenase (oxaloacetate-decarboxylating) (NADP(+))
  misc_feature (852)..(852): n is a, c, t, g, unknown, or other
tggagctccccgcggtggcggccgctctagaactagtggatcccccgggctgcaggaattcgtctcacccctagaaaaatatacgtcttcctcttgtgcccacatttgaacgcgcttggacatatacacactctggctcactcggtcgttgtcccttcattgtcttcccaggcccccatcgaccctgaaaagggacgcgagccacatgctcatgcggcccgattgaggacgtctacctgcgaatatcgccacttcctaagagcagatgattgccccatgagccttctccttaacgagctgatacacactgttgcgagacccgacgccacaagctcggcttgttcttctccgatgttgagcgacgacgcacactacctccggggactgttgccacctggacttgcctcaccagcattgtctgagaaaaatgtcttgcataacctgcaccagtactgatagccgctgcacggctacaatctccttgatggacctactcgtagcacaacgagatgctctgcatctagctcctcatcgacaacgtctaggagctgctccccgtcgtctacacgaccactgtgggtcgagccctgccataagtacgggatgcatctaccgtcttcacgcaggggcttgtacatcaacttctcaggaacaagggctaaaatcctactaggtgctcaaaaaactggaccccgaaaggatggatcctaggatattcgacatccccgaaatggaggaacactttccttcgagcctccggtaaatctcacgttaccaagggaatggggtaatttcccgttgggttaaaaaccccccccttctaccatagcgcctttagtaaggcgttttaancttttccaccttatcctttgtgccaag

SEQ ID NO: 87087 - DNA, 858 bp, Zea mays
  misc_feature: Ceres CLONE 1573942
  misc_feature: Encodes the peptide sequence at SEQ ID NO. 87088
caccgcggtggcggccgctctagaactagtggatcccccgggctgcaggaattcgtctcacccctagaaaaaaaaaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctcggctagctgctttccagtgaccaaaagaatttcaagaaccctttcccttcttccccccggggctgtctggcatttgggtttgaaaacaaatgcattcctgaaaattgtttgttgctccccctccccccggtctttgtaaaaggggttcccaggggattttgaaaaaacccccttgaaaataacgctttcttaaagggcccctgttttgggggtgaccccccccgaaaaggggaattggcgtggcctctttcgcgggggcccaaagaaaaaactgtgttttttggaccttgttcggggggcccacttttttgctccaa

SEQ ID NO: 87088 - protein, 51 aa, Zea mays; identical to SEQ ID NO: 13325
  misc_feature: Ceres CLONE 1573942
  misc_feature (1)..(51): Pfam Name: AdoMetDC_leader Pfam Description: S-adenosyl-l-methionine decarboxylase leader peptide

SEQ ID NO: 87089 - DNA, 797 bp, Zea mays
  misc_feature: Ceres CLONE 1573943
  misc_feature: Encodes the peptide sequence at SEQ ID NO. 87090
ccccgcggtggcggccgctctagaactagtggatcccccgggctgcaggaattcgtctcacccctagaaaaacctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggggatataacgacaaaccacttcctcccctatccatcgtggaagccccctgcttttcgttggagcagggccactggaacagcaaaattcttggttacctgggaattcat

SEQ ID NO: 87090 - protein, 213 aa, Zea mays
  misc_feature: Ceres CLONE 1573943
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFLPYPSWKPPAFRWSRATGTAKFLVTWEF

SEQ ID NO: 87091 - DNA, 946 bp, Zea mays
  misc_feature: Ceres CLONE 1573944
  misc_feature: Encodes the peptide sequence at SEQ ID NO. 87092
tggcggccgctctagaactagtggatcccccgggctgcaggaattcgtctcacccctagaaaaaaggggaccccgacgcgacccgcgtgtgcttccgttccagctttccttccccaacagctcgacttcctccgcaagccgccgtgccagtcgccgccggccgcgatgggtagcagggtggcagcggcgctgatccggcggggcaggtacctggcatcctccctgctgacgcctcgtctgccgagaagcgccctcgctccggctccaccgcatagggttggatctgcctcctcctcttgcggcggcggcggcggcggaagctgcctcctcccgccaaggtctgggccagcgggggccttctcttacgcttcccggttcggcaacttccacgccttccgatccctcgctcccaaagccatgttttggccaatgcacaaaggagaatgtcaactacgggcgacagcactgaacctcaactgtgggcccatgggagcaagcaaatttcagggatttcaagcttggcttgtttaacaaaaagggggcctccaatgttgcaaaaagggggggtcggggaataatgggcttccttttgggttggggccctgccctgggggggtttcaagccttggttccaataatcgggggaaggggaaatataacctctccgggcttcccacccgttcctgggggctggtcacaaggaacttggaacttgggaaattttcccccggggggaaaaatacccttcccaattggaccaaaaaaaaagcttgtggcaactttggggaattttgaaaaaatacaaaaccgcgttcccccctgaaatccacaaaggggggaaaaaaaagggaaagaagaccctttaaaaaatttcccaatttttttttcctgggggagggggtttctcccccccaaaaattggggggaaaaaacttttgggtttttt

SEQ ID NO: 87092 - protein, 121 aa, Zea mays
  misc_feature: Ceres CLONE 1573944
MGSRVAAALIRRGRYLASSLLTPRLPRSALAPAPPHRVGSASSSCGGGGGGSCLLPPRSGPAGAFSYASRFGNFHAFRSLAPKAMFWPMHKGECQLRATALNLNCGPMGASKFQGFQAWLV

SEQ ID NO: 87093 - DNA, 820 bp, Zea mays
  misc_feature: Ceres CLONE 1573945
  misc_feature: Encodes the peptide sequence at SEQ ID NO. 87094
aagctggagctcaccgcggtggcggccgctctagaactagtggatcccccgggctgcaggaattcgtctcacccctagaaaaagcaacccaggctgtgcggggcggcagggcagcggcggcgacatctgcatctgcatctcccacctcgtctccctcccgcatctgccctgcctcgatcccgccgccagccatctaagggagccgggagccatgtctccctccggcgagctgctggcgtccatctcctccgctctcgccgtggccttcgtcttcctcgcctgcgtcgagctcggcgacgccgccgccgccgtcagcgtctaccgcctcatccagtacgacctcgccggcgccccgctcggctcccgcgccgcggtcctcaaccaccacgccgcggtgctcccgctccctgccggcgcagacctctcccgctccgccctcgtcgtgccgctcctcgaccttccgctctccttcctcagagagtacctggtggagaaaaaaacagctggggggattgctcattttgctcccgacaaaccgcggtgataaggatagtgcggatgacaagggtcaagtcaaaggtgtactgactgagctggagaagttgcttgtgcacgaacaagttccatatccagtgtactttgctttgcatggcgacaattttggtaacctgctggcagatatcataaaaatgcctcttcaggccaaaccagcctctgcaacaacaggaggtttacaaactttgtcgtggtcttcagcagaaccctagaaaaatggtcatctcccgaacattttctaattatccagggaatggttacccta

SEQ ID NO: 87094 - protein, 110 aa, Zea mays
  misc_feature: Ceres CLONE 1573945
MSPSGELLASISSALAVAFVFLACVELGDAAAAVSVYRLIQYDLAGAPLGSRAAVLNHHAAVLPLPAGADLSRSALVVPLLDLPLSFLREYLVEKKTAGGIAHFAPDKPR

SEQ ID NO: 87095 - DNA, 827 bp, Zea mays
  misc_feature: Ceres CLONE 1573948
  misc_feature: Encodes the peptide sequence at SEQ ID NO. 87096
ggagctccccgcggtggcggccgctctagaactagtggatcccccgggctgcaggaattcgtctcacccctagaaaaaacacacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgaggccgacgcgcgcaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatattcttctcggttgctactcagctaggcagatatgttatcactatgatgagcagcggtgttgtacttggggttggattccagctgtcaggcggagacagccaaatgaacgaactaatttggtatagctggcttgggtggggtgattatcggcacaatgataggtgcaaacagtgtcctagaagaacactgcaaagctggacctcgcaatgtcgtcataactggaaagcacagaggggtaggaaaagcgcttgctcgtgagtttctttcttctgggagacccgtgtgtaattact

SEQ ID NO: 87096 - protein, 195 aa, Zea mays
  misc_feature: Ceres CLONE 1573948
MAAAAAAAVAHLSIHGRLRRSPEHRPSITTTTTSSSSPSAHRPSLLRCRAFKQEASDGDPAEADARKRRKGPLYKLKAAIQGLAGSRSAAAEVYGGEYQYQRAVEKAEEIFFSVATQLGRYVITMMSSGVVLGVGFQLSGGDSQMNELIWYSWLGWGDYRHNDRCKQCPRRTLQSWTSQCRHNWKAQRGRKSACS

SEQ ID NO: 87097 - DNA, 813 bp, Zea mays
  misc_feature: Ceres CLONE 1573951
  misc_feature: Encodes the peptide sequence at SEQ ID NO. 87098
  misc_feature (795)..(795): n is a, c, t, g, unknown, or other
tggagctccccgcggtggcggccgctctagaactagtggatcccccgggctgcaggaattcgtctcacccctagaaaaaacgcgagcaaagtatcggtgcctatatacctcattattttcagtccgagtggcgaaacacgccgcagcttccactgaccactgctccacaggctcatatccgattccgatcctaagacctcagctgctgcggcatccacggccaactcaagcgctggcaactggcaagggcagatgatctgtgtatagcactcgctaccatctcttgatttccccctcaggtcgctgaccaagggtcctgtcctgcctggagccgtcgacacccgggtggccagcgattgctttgctgctccaggaaagaagccaaaaaaaaaaaacgaagaattaaacatcgattgaaagggaaaagacaatgccaagcctaaactgagaggcgcacactggatttcgcatcagttcatgtcgttccttacaccgtcaaatttgacgaatcacctcgccacgccttgattttgttttgtcctccgcttctggccgggctcagttcagctgtatggtattggtatcgccatgtcaagcgacctctccacacgctcctcgccttcctcctccaccgcgtcgccttccgacgactcgcggcggcaggagcaaggccaggcggcgggtaacgccagcgggagccggcggtggcggtggcgcctcgggctgggcgcggcgtgggcgctggacccccgcgcgaggtggggtctgggactggaaacgcgcctacctcctggnctgcgcggccggggctca

SEQ ID NO: 87098 - protein, 75 aa, Zea mays
  misc_feature: Ceres CLONE 1573951
MSSDLSTRSSPSSSTASPSDDSRRQEQGQAAGNASGSRRWRWRLGLGAAWALDPRARWGLGLETRLPPGLRGRGS

SEQ ID NO: 87099 - DNA, 830 bp, Zea mays
  misc_feature: Ceres CLONE 1573953
  misc_feature: Encodes the peptide sequence at SEQ ID NO. 87100
ggagctccccgcggtggcggccgctctagaactagtggatcccccgggctgcaggaattcgtctcacccctagaaaatctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcaccccgacaaagaggcgcccgtcatcgactacaagctcgcgttgctctttcagcccatgcttatgctcggcataaccatcggcgtagagctcaacgtccatcttccatactggctaaaccactgcccccataataacctccttcgaaagcaacctccttcaagaatccttccacaaagggaatttctgaagggggagggaattcttgatgggggaggggaggaaacccggaattcttaacggaaacaccccggggaaaa

SEQ ID NO: 87100 - protein, 219 aa, Zea mays
  misc_feature: Ceres CLONE 1573953
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNLQVSHPDKEAPVIDYKLALLFQPMLMLGITIGVELNVHLPYWLNHCPHNNLLRKQPPSRILPQREFLKGEGILDGGGEETRNS

SEQ ID NO: 87101 - DNA, 796 bp, Zea mays
  misc_feature: Ceres CLONE 1573961
  misc_feature: Encodes the peptide sequence at SEQ ID NO. 87102
tggagctcaccgcggtggcggccgctctagaactagtggatcccccgggctgcaggaattcgtctcacccctagaaaaaccctcacctctcgctaccaccaccactgccccggatccataccagctgcagcagcagcgcgcgcgagctagcttcggtcggtcgatagatcgatcgatcgctcggccatcttggcgcgggaggagcatgcgctgctgtcaacggagatcgtgaaccgcggcgtggagccgtcgggcccggacgccggctcgccggccttctcggggcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagtccgacgaggacagcctggcgttccagtcacgtctgctggccaagtcctgcatcggcgacgagtcgtacatgccgcgctgcgtgttcgagcccaacgccagctgcgactacatgaaggagggccgacgctaagcgtccacgggcatgt

SEQ ID NO: 87102 - protein, 80 aa, Zea mays
  misc_feature: Ceres CLONE 1573961
  misc_feature (1)..(80): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLIDFACYKPADELKVSKAEFIDLARKSGKSDEDSLAFQSRLLAKSCIGDESYMPRCVFEPNASCDYMKEGRR

SEQ ID NO: 87103 - DNA, 833 bp, Zea mays
  misc_feature: Ceres CLONE 1573962
  misc_feature: Encodes the peptide sequence at SEQ ID NO. 87104
  misc_feature (625)..(625): n is a, c, t, g, unknown, or other
ctccccgcggtggcggccgctctagaactagtggatcccccgggctgcaggaattcgtctcacccctagaaaaaacccaacattgaatttgaagttctgtttcctctttgttcagacgacactctccaaatgaatgccttatattttgtgttgctcctcttttctgcagagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataaaaatggccgtgtgggtactcaccacgatgctcactgctgcgttctcatacaaggtggcagcaattatgccactcccggtgcaagtgctggtgtgggcaatggcaggagcaactgtgttcggtgggtttttatgcttttcttcatcacangaaaaaaacgcccagctggaacccccaaaacattacgaggtacaaatctcatctgtgccttgctctagttttcccaatgggaattactatgcatgattttgtttggaaactcttattgcatccatccagattatgcatcccccataagggtatatcttgatgacatctgtggcctgatggtgtaccaaatgtctctatctctgcatta

SEQ ID NO: 87104 - protein, 173 aa, Zea mays
  misc_feature: Ceres CLONE 1573962
  misc_feature (142)..(142): Xaa is any aa, unknown, or other
MASKQQQKQFLDEAMIKQPTPEEDREGAWPSVLTIIGFGFLTFNSFMAVYRSNGDVGSISFVVFSYLVLVLLFYCLRRFETTPPESPSREHIKMAVWVLTTMLTAAFSYKVAAIMPLPVQVLVWAMAGATVFGGFLCFSSSXEKNAQLEPPKHYEVQISSVPCSSFPNGNYYA

SEQ ID NO: 87105 - DNA, 1070 bp, Zea mays
  misc_feature: Ceres CLONE 1573963
  misc_feature: Encodes the peptide sequence at SEQ ID NO. 87106
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
tttttttccgcaggatgcgcgcagtttaatctaatgtgagatctttctcccccccctcttnnnnnnntnnnnnnaagaagctggaactccccacggtggcggccgctctagaactagtggatcccccgggctgcaggaattcgtctcacccctagaaaaaaccccaaatccctccttccattctacttgccccttcgctctcctgatacaccccccgaccaccgcctcctccaccaccatagcgcccatgaatcccacattctcacaaacggtctcccgaccccttatgtggcttcagatggccctctcaaaatccacggagagcaagcagggaccagcccggcaacaccggaggaacatcgccactgcccatgtgccatcctgcaccctaccggccggtgaggacttctgaatcctcactgatgactagcagggactccgtcaagaggatattccggaactagaaatgggtttgtccaaccttaatgtgctgcacaatctgccgttctactcctccggaaaaattcgagacacttgcaaaagacatacccaaagcacggacgcaccaaattagtagcccattataggaaaactggccaactgggattcccttgcaaaccccttaacacacaaaagagacccagcgggtttactggcatttcccctgggagtactaggaaacccccccgtcgggggaaaaatatgaacccgggactcacagggtaaaaaaaatccccaaggggggtttaacaaagaagctttctaaaaaaagatttcccaccaattttaaaataaacacccccacaatttttgtggtggaaatggattttttgggaagcaaatgaccctggggaaaaaatatttcctttaaatataatgggcccccccccgtgctctgaatattcccaccccatggaaaacttgaccgtgaaacaaaaaaatttttccttgagaaagggcctccatcttggagaaatacagggcccggaaaaataaattttcccccccattaggggccgttgcacccctaacacaaaaaagctgttttcttggaaaggggttcaccaaag

SEQ ID NO: 87106 - protein, 37 aa, Zea mays
  misc_feature: Ceres CLONE 1573963
MALSKSTESKQGPARQHRRNIATAHVPSCTLPAGEDF

SEQ ID NO: 87107 - DNA, 805 bp, Zea mays
  misc_feature: Ceres CLONE 1573964
  misc_feature: Encodes the peptide sequence at SEQ ID NO. 87108
  misc_feature (805)..(805): n is a, c, t, g, unknown, or other
ggagctccccgcggtggcggccgctctagaactagtggatcccccgggctgcaggaattcgtctcacccctagaaaaaatgttcgcgtcgtccgccttctctctctctctaacccaatggcagccacctctgcgaccgtcgcgaccactcgccaagtaaattttcttccgcccacctgactacgcctcgacctcggcctcggcgccgcctccgtaccgccggacgcggcagccatggcgccagcggtggggctcaagcgctccgccacgcagaccataactctgccgccgcccgacacgcgggtggctgtgcgcgatgtcatgcgctccacgatacccgtcgcagcccgccgtggcgccggcgtccacggagaggcaggcgcccgccgcggcattgcaggggatcctgtgcctgcacgaggtggactggaggacggtggagctacgtggtggacggtggggccgcgaaagggaggagcacgggcggggccggccccactggggccgccgtcacgaccgtgacgctgtagtcgacgctttcgactgccgagggaaatcatggaatccttcaaatcatgtgaggtgcctgaagggtttccagacagtgttactcctacacacgtaccccacaagagctggagggctctgaaccatgttaatagctggacccacggaaagtggtcacaacaagaaacttggtttgagttctgtcgggagtcttcttaaagcaaggggaaaacacacgggaccttttgctaatcaaccgggattcctaagggaatggtaactgggaaatagttcgggan

SEQ ID NO: 87108 - protein, 95 aa, Zea mays
  misc_feature: Ceres CLONE 1573964
MAPAVGLKRSATQTITLPPPDTRVAVRDVMRSTIPVAARRGAGVHGEAGARRGIAGDPVPARGGLEDGGATWWTVGPRKGGARAGPAPLGPPSRP

SEQ ID NO: 87109 - DNA, 828 bp, Zea mays
  misc_feature: Ceres CLONE 1573965
  misc_feature: Encodes the peptide sequence at SEQ ID NO. 87110
tggagctccccgcggtggcggccgctctagaactagtggatcccccgggctgcaggaattcgtctcacccctagaaaaagcttaccgtctccaccgcatctcatctcgccggcgagccagcctaaccaatcgccaatgctcacctcgttgcttccaccgcccaccgtcccgatctccaaaccctccgcgtcggcgtcgcccaagaccgccaagcccaggtccgccgtgctctccgcctccgccctcgccctcgcccccgcctcgacatccgattccgacgatgcgcccggcgggggcgagggcggcggcgtccgcctctcctcgctcatccgctccctctgcgccgcggggcgcacagcagaggccgcgcgggcgctgtccgcggcgggcggcggcgcgggcgtcgtcgcctacaacgccatggtggccggctactgccgcgcgggccagctcgaatccgcgcgccgccttgccgccgcggtccccgtcccgcccaacgcctacacctacttccccgtcgtccgcgccctctgcgcgcggggccggatcgccgacgcgctcgcggtgctcgacgagatgccccgccgcggctgcgcccccatcccgcccatgtaccacgtcatcctcgaggccgcctgcaggggtggcggcttccggagcgccgtcagggtgctcgaggatctacacgccaggggctgcggccctcgacgtcgggcactgcaacctcgttctcaacgccatctgcgaacaaagggtccggtggacaaggcccctccacctgctgcggggacatgcccgtcccttcggctgcaaacaagaagtggtgga

SEQ ID NO: 87110 - protein, 231 aa, Zea mays
  misc_feature: Ceres CLONE 1573965
  misc_feature (123)..(157): Pfam Name: PPR Pfam Description: PPR repeat
MLTSLLPPPTVPISKPSASASPKTAKPRSAVLSASALALAPASTSDSDDAPGGGEGGGVRLSSLIRSLCAAGRTAEAARALSAAGGGAGVVAYNAMVAGYCRAGQLESARRLAAAVPVPPNAYTYFPVVRALCARGRIADALAVLDEMPRRGCAPIPPMYHVILEAACRGGGFRSAVRVLEDLHARGCGPRRRALQPRSQRHLRTKGPVDKAPPPAAGTCPSLRLQTRSGG

SEQ ID NO: 87111 - DNA, 802 bp, Zea mays
  misc_feature: Ceres CLONE 1573967
  misc_feature: Encodes the peptide sequence at SEQ ID NO. 87112
  misc_feature (546)..(546): n is a, c, t, g, unknown, or other
  misc_feature (549)..(549): n is a, c, t, g, unknown, or other
  misc_feature (552)..(552): n is a, c, t, g, unknown, or other
ctccccgcggtggcggccgctctagaactagtggatcccccgggctgcaggaattcgtctcacccctagaaaaaatggcgacagagtggccgccgacgctcctttccgtgtggtgtagggctgcagattccttcgcgctcctcctgctcccagcgaggaaaagagagcacgaactaaactaggaaccatccctccccggcattcattcccttgcccttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgttcctgctttgcggtttcttgctctgcttttgagtggagccgctgtggagtggacggtgtggtgtggtgtgggtcggcggtgaggtgaaaggcttggtttctttctttcttgcgagggaggataagggaaagggaaggcgaagaggaggatggcggaagggaggggcggcnccnccnccgaagcaggaggagctgcagccgcacccggtgaaggaccagcttcccagcgtgtcctactgcatcacaagcccaccgccctgggctggaggctgtcatcccttgggattccagcactacatttggtgatgctggggcacatccggtcatcataccaaaggggctcttgttcccccaaaggggggaggagggaaaacgaggaagaagggcccggggggattcaaaaaccctgcttgtttcgtttgccgga

SEQ ID NO: 87112 - protein, 35 aa, Zea mays
  misc_feature: Ceres CLONE 1573967
MATEWPPTLLSVWCRAADSFALLLLPARKREHELN

SEQ ID NO: 87113 - DNA, 901 bp, Zea mays
  misc_feature: Ceres CLONE 1573968
tggagctccccgcggtggcggccgctctgaactagtggatcccccgggctgcatgtaattcgtctcacccctagaaaaagctactaggcgggcgctagcactgcgaattatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgactccctctgcgccctcgccctcctccccttcctccccgggcacgcccgccaccccgtcgcctccatcggacaccccgtcgcccccggtcgtccgggggaggggggagggtccccgccgtcatctggggggtgggcgaatcacgccggtccttcccactcgtcttcccaagtcgcactcgcccggggggggccggtggctgacaacttccgggcctggcctcctcactccgtgagggggcccttgcctttccggcgggccctctagcgtgtctgcgcgcattccccgatttcaaatttggcccgatggcttgttttccgtcaaagaaaggttgcgtgcgcacgtgtgccccgcgcgcatagacttcaggaaaattaaatggaatacctctggtgcttccgcccgccgctgtgccttttggagatgtgagagggggacccttgcgtcggggggtg

SEQ ID NO: 87114 - DNA, 796 bp, Zea mays
  misc_feature: Ceres CLONE 1573974
  misc_feature: Encodes the peptide sequence at SEQ ID NO. 87115
ggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggccttcaccgtccgcaacatcgcctccatggtcccaccctacgacaagatcaagtacgccggcacagggtccgccatcgagtacgccgtgtgc

SEQ ID NO: 87115 - protein, 139 aa, Zea mays; identical to SEQ ID NO: 81816
  misc_feature: Ceres CLONE 1573974
  misc_feature (79)..(139): Pfam Name: Pro_CA Pfam Description: Carbonic anhydrase
  misc_feature: SWISSPROT Homolog: EC 4.2.1.1 Carbonate dehydratase

SEQ ID NO: 87116 - DNA, 804 bp, Zea mays
  misc_feature: Ceres CLONE 1573975
  misc_feature: Encodes the peptide sequence at SEQ ID NO. 87117
ctggagctccccgcggtggcggccgctctagaatagtggatcccccgggctgcaggaattcgtctcacccctagaaaaaagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctggagcggtcggggctgggggaggagacgtgcctgccgtacgcgcagcactacatcccgccgtcgcgcgacctggagtcctcccgcgccgaggccgagctcgtcatcttctcggccatcgacgacctgctggccaagacgggcgtgtccccgcatgacatcgacatcctggtggtgaactgcagcctgttcgcgccgacgccgtcgttcgcggacatggtcatgcgccggtacgggctccgcggggacga

SEQ ID NO: 87117 - protein, 204 aa, Zea mays
  misc_feature: Ceres CLONE 1573975
  misc_feature (71)..(204): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLERSGLGEETCLPYAQHYIPPSRDLESSRAEAELVIFSAIDDLLAKTGVSPHDIDILVVNCSLFAPTPSFADMVMRRYGLRGD

SEQ ID NO: 87118 - DNA, 858 bp, Zea mays
  misc_feature: Ceres CLONE 1573979
  misc_feature (480)..(480): n is a, c, t, g, unknown, or other
  misc_feature (483)..(483): n is a, c, t, g, unknown, or other
  misc_feature (858)..(858): n is a, c, t, g, unknown, or other
agctcaccgcggtggcggccgctctagaactagtggatcccccgggctgcaggaattcgtctcacccctagaaaaaaccccccacagccgggggtcgccggtttccgcgactccaaatccgcgtgcgccgcccgccctctaaatctgcctcgccggcagccgggcgggggccaccacgtcacacccagcctctcctctccgcccgcggcccgcccgcttcttcttcctcgccatcccttcttctagcgcggaggcgcagatccatcgggcttcgggggctcggttccatccctctgccagctgggattggattggagcatcttcccagcaccacccacgcggaagccatgaccattcagttgctccgctgacgactcctctgacgacagcacggctgcgctgacctgcaggcctctcgcccacgctgccctgacagggtaaagtcagggggtggcgtgtgtgggtggggggggggcgtcntcngcttcgacaccaaatccgccgccgcgctctccaaatgcatgatcatgggggcctcggcgtcatcggtttggtacaaccctccaggtgtcgcacccgaccaaggaagggcccgtcatcgactacaagctcgcgttgcttcttcaacccatgcttatgctcggcataaccattcgcgtaaaactcaccgtcatctttccataatggctaatcactgtccccaataaaaatcctctttcgtagggcccctccctccaaaatcctttctaaaagggaaatcttgaattggaagggaaattcttaatttgaaggggaggaaaaccccggattttttgacggaaaaaacacccgggggaaaaagagaaaccttccaaattn

SEQ ID NO: 87119 - DNA, 1179 bp, Zea mays
  misc_feature: Ceres CLONE 1573986
  misc_feature: Encodes the peptide sequence at SEQ ID NO. 87120
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
nntttattttannnncctttgttctacggtggttaattagaccaaagtataatactacgttttgtttnnnnccaaactggaactccccgcggtggcggccgctctagactagtggatcccccgggctgcaggaattcgtctcacccctagaaaaaatgcggctgtgatgcacaccaacccagccatggccaaggcagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagagggagggggagaaccccatgatgacacccctgccctacatcatcatcttcggcatgtccacccccttcgtcatcctcgccatcgccgttcgccaaatggctggatccaaggtcccgtgtgcgatggaccggtaaccgcgatccagccagccctgggatcattagattgctggacctcgttcaagccctgccatctacatcacagccgtggaggtccctgcggaacttttagataccccttccattatctttaggacgaccaagtaatttcccttttgccggaggtgaaagcccataaattattgcccttggaatcccccgtagggattgggaatattaaaatcccccctaaaaaaacaggatattaaaccggttgtggttgccaccaaaagaaaaacctgttccaaattctcttgataaacaatcactttacaaagaaacaaaaaaatgtttgttttagaaagaccttgtcccccagcctccgcctctatactttacgaggagtcacataactcgcgaattggtccgcaaagagtgaaacccaataggggccgattcgttgaactcctctttcccagtgtgaccccacccatcaagggaaccaataaattgggagacaaatatgcatctctggggtacaccataccagtaaattgaccaatgcgagaggtatataagctgcgaaccgcaattaaaagatacattgtataaatcgagaatagttgatatctcgactatactgagagttagctcccacc

SEQ ID NO: 87120 - protein, 123 aa, Zea mays
  misc_feature: Ceres CLONE 1573986
MAKAAPPLLAAGSRTAITAQQPSSRKGAAGTGLFCSRAIVSKRTRVTAKLGDGELKPAGKRKFITKEEEPEQYWQTAGEREGENPMMTPLPYIIIFGMSTPFVILAIAVRQMAGSKVPCAMDR

SEQ ID NO: 87121 - DNA, 827 bp, Zea mays
  misc_feature: Ceres CLONE 1573987
  misc_feature: Encodes the peptide sequence at SEQ ID NO. 87122
tggagctccccgcggtggcggccgctctagaactagtggatcccccgggctgcaggaattcgtctcacccctagaaaaaatctccgcccacacaacacaacaaagcacaccaccccaccccccgaaacggacgctacccctccccgcctcgtctcgctccgctccgctccggcccgttccggctctcgccaccccagccgagatgcggtcgccgccgcccccaccgtggcgcgccgggcgcctccattccccgctccccatgctcctgctcttcgtcgcggcgctggcggcgcgggcgggggccgacgacctcgcgagcgacgcgcgggcgctcctggcgttccgcgacgccgtggggcggcgcctgacgtggaacgcctcggacgtcgcgggggcgtgctcgtggacgggggtctcctgcgagaacggccgcgtggcggtgctgcggctccccggggcgacgctctcgggggcagtccccgcggggacgctcgggaacctgacggcgctccacacgctcagcctccgcctcaacgggctctccggcgcgctcccggccgacctcgcctccgccgccgcgcttcggaacgtcttcctcaacgggaacaggctgtccggcgggttcccgcaggcgattctcgcgctcccggcgctcgtcaggctctcgctcggcgggtacgacctgtcggggcccatccctgcggagctcggcagcctcacgcacctcagggtccttctcctggagaacaatcgcttttccgggcgagattcggatgtcaagctaccgccgctgcagcagttcaatgtctcgttttaccagctgaacg

SEQ ID NO: 87122 - protein, 208 aa, Zea mays
  misc_feature: Ceres CLONE 1573987
  misc_feature (37)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MRSPPPPPWRAGRLHSPLPMLLLFVAALAARAGADDLASDARALLAFRDAVGRRLTWNASDVAGACSWTGVSCENGRVAVLRLPGATLSGAVPAGTLGNLTALHTLSLRLNGLSGALPADLASAAALRNVFLNGNRLSGGFPQAILALPALVRLSLGGYDLSGPIPAELGSLTHLRVLLLENNRFSGRDSDVKLPPLQQFNVSFYQLN

SEQ ID NO: 87123 - DNA, 1168 bp, Zea mays
  misc_feature: Ceres CLONE 1573990
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
ttgtatttaannncanaaaagacgaatcacgccacaaaacagaaagcggtttttttttttggtatttcaaactggactccccgcggtggcggccgctctataatagtggatcccccgggctgcaggaattcgtctcacccctagaaaaattgaagtggtccgtaggcagctacagatgctagtaaaagcaaccagaatgaatgcgcttgcaacatgccttaagattgttgaccaacgtgggatacacagcgctgtatgctgaaataatccccagcttgatacaagatcaactcatctccatggatgcacctaatttggtttatgactaaaagaagatcgttctggtaaagtggagggatatactaattcattggcagagcctcacaataaatcttccgattggcctcgctcgtatctaaaattataatggcgtggcttctcccaacaacataaaggtgtgaggaataagtacccggtccacataaaaaattgggtggtgttaaaccccaaaccctttatcaccagctagaaagatataaaatttagcaaccccgaaaatccccaaatatacgaaaatcccgtgaaatagtttaggccttatttaggaaaaattggttctttcttctgaataccttttcctggggggggaaaaagaaaaaacgagcccccagagcaacgaatttacccatatttaaccaatattgtttaaacaaacaaatttaaaaaaatatttattacaattaatacacaaaaaatagtatattttatataatacatagggcgccacaagatacaggagagagaatttcaaaaaattagtattttcttttaaataattttattaaacatgagggttaggtgcgtcgtgggcggtctgaccgtaacttttcaaaaagattttaatataccaaatcacctactcacaaacttcaaaaaagatcagatagatgttgcgcctttaggggatttagtacgattcatgtagaaggcgaaaaaagtaccatggtaaaatttagtcctcacactataatatgtttaaacgaaatggataggggctagaatagagaactccaaatatattgataattaagtaataaaaattatgtgctgtgcagggagtttcaatctggcgtgaactgtggttcgtataataataagcaaatccaac

SEQ ID NO: 87124 - DNA, 786 bp, Zea mays
  misc_feature: Ceres CLONE 1573993
  misc_feature: Translation starting site: 190
agctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatggaccccatcaacaccgtctttgatgcccagcgtctcattggcaggaagtttagtgatgcctctgtccaagagtgaattaagctgtggccctttcaaagtcattcctgggccccgtgagaagccaatgatagttgttcagcacaaggggggaggagaaacagtttgcagccgaagagatctccttcatggttctcatcaagatgcgtgagatccctgaaagctacctttggcagcccgatcaagaatggctgtggcaccgtcccctgcctaactttcacgactccaagaggcaggccaccaaggatgctgggggtgattgcctggcctcaatgggcctgcgtatcatcaatgaagccaaccgctgctgctattggcctagggccttgacaagaaggcaactcagcg

SEQ ID NO: 87125 - DNA, 828 bp, Zea mays
  misc_feature: Ceres CLONE 1573995
  misc_feature: Encodes the peptide sequence at SEQ ID NO. 87126
  misc_feature (724)..(724): n is a, c, t, g, unknown, or other
ctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttcctcaaggacgatcagctggagtactttgaggagcgtcgcctncaaggatctggggtcagaagcactctggagttcatcaagctaccccatttccctggtggactggaaggaccaccggagaagggaaatttcctgacgacgaaaaa

SEQ ID NO: 87126 - protein, 226 aa, Zea mays
  misc_feature: Ceres CLONE 1573995
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYFEERRLQGSGVRSTLEFIKLPHFPGGLEGPPEKGNFLTTK

SEQ ID NO: 87127 - DNA, 881 bp, Zea mays
  misc_feature: Ceres CLONE 1573996
  misc_feature (743)..(743): n is a, c, t, g, unknown, or other
ggagctccccgcggtggcggccgctctagaactagtggatcccccgggctgcaggaattcgtctcacccctagaaaaaatcgacccgacccaggcttcacttgacggcgggagagagctcccgtgcccgacgactgattccacatccctccaccgtataaataaactgactgagatcgttcctgagggaaagagatgtgccacttcctcggcccccgccaggttttgaattgttgtttgccgcgcgtgagttttccgtgttacgcctactccaattggctatcaagatgatgggatcggggggacactgcaagtgctgtgtggctcccccatagcgggagcatgaactccttgtagggctgctgcgattccgctgcctagatgaatgatcctgcctccggagacctggagatctacctcgagtagatcgaataggagctctgactacgcgaaggggagcagggtctatcccctcaatagttaaaacgagctcattctaagtctaatagtaatgtcaacgcagagcgaaaaaggtgcactccatggccaacaacaactcatatggttgaaattgctgggagaaatggcccgaacacacatttgtagttggtattgacggcgggatcgggtagagactgctgccgactgaggccctcctagatcgactccttccaggttattgaagccgaaatttggggaatagaattagggggaaggagttccaaaaagaattagtcctttttncgtcctcccggggaatttaggtgaagcatggttgattttcgggggggacaggttaaaaaaacaatccctgggggcttttttaagttcgaaagagggtttaaattttaaagcagcacctctaaagaaatcgctgaaaaa

SEQ ID NO: 87128 - DNA, 809 bp, Zea mays
  misc_feature: Ceres CLONE 1574002
  misc_feature: Encodes the peptide sequence at SEQ ID NO. 87129
  misc_feature (678)..(678): n is a, c, t, g, unknown, or other
  misc_feature (683)..(683): n is a, c, t, g, unknown, or other
  misc_feature (758)..(758): n is a, c, t, g, unknown, or other
ctggagctcaccgcggtggcggccgctctagaactagtggatcccccgggctgcaggaattcgtctcacccctagaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggacaagaagcctccntcccnttgctgcccatcaacttcgatggactcgccaaggctttgacaccaggtgcaacgatatttgtgggccatacttgntcactggtagcgagactaccttcagtttggttggaggtttctgaaagtaaa

SEQ ID NO: 87129 - protein, 171 aa, Zea mays
  misc_feature: Ceres CLONE 1574002
  misc_feature (30)..(171): Pfam Name: PK Pfam Description: Pyruvate kinase, barrel domain
  misc_feature: SWISSPROT Homolog: EC 2.7.1.40 Pyruvate kinase
  misc_feature (128)..(128): Xaa is any aa, unknown, or other
  misc_feature (154)..(154): Xaa is any aa, unknown, or other
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASXPLLPINFDGLAKALTPGATIFVGHTXSLVARLPSVWLEVSESK

SEQ ID NO: 87130 - DNA, 1262 bp, Zea mays
  misc_feature: Ceres CLONE 1574004
  misc_feature: Encodes the peptide sequence at SEQ ID NO. 87131
  misc_feature (1)..(1): n is a, c, t, g, unknown, or other
  misc_feature (391)..(391): n is a, c, t, g, unknown, or other
  misc_feature (859)..(859): n is a, c, t, g, unknown, or other
  misc_feature (918)..(918): n is a, c, t, g, unknown, or other
  misc_feature (1045)..(1045): n is a, c, t, g, unknown, or other
  misc_feature (1165)..(1165): n is a, c, t, g, unknown, or other
  misc_feature (1235)..(1235): n is a, c, t, g, unknown, or other
  misc_feature (1255)..(1255): n is a, c, t, g, unknown, or other
naatcccgcggcttccggcctgtgtacccgggcgtggtggaatcgggggggacggcgtgggggggtgggagggggagagttggactccccgcggtggcggccgctctagaatagtggatcccccgggctgcaggaattcgtctcacccctagaaaaactagtgccctcatctgtctaaaaccctagttcggtgaagcactagcctgagcggcggctcggaccggcgagacgactgaccgaacgagtgcgccagagagctccctggaaaccttgccccgcagtaaatggaacgctgacgtgcttactagtgagaggcagaagatccgctgaggcccgaggaggaagaagatggaggaggacgaagaggaggggggggacgactggtgctccnacggccaaaatgtgggcagtgggctgttggtgttggttctggggctttaagtttggatttcaagaaggtgaatttttcaaaggcacttgacccagctgaagcgacccctcttgattttgcaatttgaattgttgaagggatgttgggggtgttggagtttcttacaggccttccatacaaaggccgctttaaggctttttgttccgctctcctcaagaggtttgcctgcaacgaaaaaataatggcctgtggaacccctgatcgggaccatatacaaacatgttcgccctttgccgtacaccaaagataataatctcgtgtggagtagtgccgaaacttttgggcacgcgcacacgagctgagtgttaagaaaaaagcgtcggatccactctaggggcttttggtgcgtgcgcgcataagaaagcgtggacagctcataatatgcatgagacgagcacagacacgatnttgtgtacctcattacactgtcgtgaataacaaactgcgcggcgtgttaagacgaggancaaatgacatggaaaactgatcacccatatttcttggaggacccgggcgcttgtatgtatctatacactatcgcctatgagcaaatgaaaacttaaattccgggcagaatttgttgtggcgcgcccntgatctgagcaatacggagatgtcgcacatatagactacatatgaggcgtgcaacagatctagtctccctgtatagctacgtgccaaagtaaggacacgcgttgatttatgctatggatnagcgcgatgtgaggagtgataaatcgagagtatgtagagcgctgtgcgcaatttactcgagcacaagtantacccggagatgctgctgtnacacatg

SEQ ID NO: 87131 - protein, 36 aa, Zea mays
  misc_feature: Ceres CLONE 1574004
SRGFRPVYPGVVESGGTAWGGGRGRVGLPAVAAALE

SEQ ID NO: 87132 - DNA, 808 bp, Zea mays
  misc_feature: Ceres CLONE 1574005
  misc_feature: Translation starting site: 317
  misc_feature: SWISSPROT Homolog: EC 3.1.1.11 Pectinesterase
  misc_feature (808)..(808): n is a, c, t, g, unknown, or other
ctggagctccccgcggtggcggccgctctagaactagtggatcccccgggctgcaggaattcgtctcacccctagaaaaaacccccgcctcgccctccgtcgtctcagcgtatgttgtgcatgtgaagagagagaggaagagggtgacgagcgagaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaggcggcggccaagtgcgagtacagaaagcactccggccaccggtacaggcacccggtgggcgtgcggaagatcgtggtggacgcgggcggcgccggcgatttcgtctccatccagcgcgccgtcgactccgtgccggagggcaacaccgtgcgcgtcgtcgtgcagatcaacgccggcacgtacatagagaaggtggtagtgccggcgtcgaagccgtacgtcacgttccagggcgccgggcgcgacgtgacgtgtggtgaagtggcacgaccgggccagcgaccgcggccccgactggcagccgctccgcacctacaacaccgcctcagtaaccatcctagctaactatttcaacgctaagaacatcagcttcaagggtgagcagccgtttgcccagcagaccacccagtacgtgcn

SEQ ID NO: 87133 - DNA, 789 bp, Zea mays
  misc_feature: Ceres CLONE 1574008
  misc_feature: Encodes the peptide sequence at SEQ ID NO. 87134
  misc_feature (541)..(541): n is a, c, t, g, unknown, or other
  misc_feature (549)..(549): n is a, c, t, g, unknown, or other
tggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaatttcactcgtcggctacatgtccgaacccatggccagcagaagaaccctatctctgcacagcacccatcaagtatcagtttcgcaactactctgcgaactacatctactggggcaagggncagcatcngctgcagctcatcaaccagcgctccgacttctcctttcgccctcttcaccggcggcctcagcaacccgaggctgatcgccgttgtcggagccccatatcggtcaagaaccccacaggcggccggtggtcccgcggcctggccgcaggggcacgtcccacgacgagatggacgggggacgtggaaccagcggctacggcattcgatgaaggcgtacccccgttcgtggagtggggcgctgc

SEQ ID NO: 87134 - protein, 212 aa, Zea mays
  misc_feature: Ceres CLONE 1574008
  misc_feature (133)..(133): Xaa is any aa, unknown, or other
MAVALLAALVASAAMFMLAGTASASPAEGIQPLSKIAVHRATVEMQPSAYVRATPSLLGEQGEDTEWVTVKFGWKEPSEDDWIGVFSPSEFHSSATCPNPWPAEEPYLCTAPIKYQFRNYSANYIYWGKGQHXLQLINQRSDFSFRPLHRRPQQPEADRRCRSPISVKNPTGGRWSRGLAAGARPTTRWTGDVEPAATAFDEGVPPFVEWGA

SEQ ID NO: 87135 - DNA, 810 bp, Zea mays
  misc_feature: Ceres CLONE 1574009
  misc_feature: Encodes the peptide sequence at SEQ ID NO. 87136
ctccccgcggtggcggccgctctagaactagtggatcccccgggctgcaggaattcgtctcacccctagaaaaagctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgcaaactgacacccggcgtttcgcggcggagctcagggccacccccggccggatcgccggcaatggcgcctgcgccgtcgcgtcactgtacacgctgcagggcaaagaagggcgtcaaccaggatgctatgatctttctgggagaacttccgttcaagagatgatcccatcttttggggtggtggtttgaccggcatggaactttatggccccttggtttgccaaaaagaaataaaagaatctcctggcctcaac

SEQ ID NO: 87136 - protein, 175 aa, Zea mays
  misc_feature: Ceres CLONE 1574009
MVEAAAGRRTGTSRRRPSGSGGEHRHLVALAVAARVAMVTTRSVGPAAVAEGDGAGAAVTDAGAAGGGGRCMEDFFDCLLGLLGALGMTWAAARPQRQPRPPLPRGAAGAGPAQTDTRRFAAELRATPGRIAGNGACAVASLYTLQGKEGRQPGCYDLSGRTSVQEMIPSFGVVV

SEQ ID NO: 87137 - DNA, 782 bp, Zea mays
  misc_feature: Ceres CLONE 1574012
  misc_feature: Encodes the peptide sequence at SEQ ID NO. 87138
ggagctccccgcggtggcggccgctctagaactagtggatcccccgggctgcaggaattcgtctcacccctagaaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaacgccgcaccatctgcggctgcctcaagaacgtcgccaacggcgccaacgggagcggcacctacatcagccgcgccgccgcgctgcccagcaagtgccgcgtcgccctgccgtacaagatcagcaccaacgttaactgccacacgatttatttaagtgatgaaggcgtcctgtgcgcgtcccgggcgaggaatgcatgcatgggcccttgccggaaagtaataaattaatgctaccggggatttttaagctatatccagggggtgccgggcccccagtcaatttaatttggggggttttaggaagggcctaaccaggttcctaaaccggtgatccctgggaagccaggtgcccggccaaccaaaaaacctt

SEQ ID NO: 87138 - protein, 148 aa, Zea mays
  misc_feature: Ceres CLONE 1574012
  misc_feature (32)..(119): Pfam Name: Tryp_alpha_amyl Pfam Description: Protease inhibitor/seed storage/LTP family
MAAPKLATLALAVLLAATVVAPPAAVRAAMSCSTVYSTLMPCLPFVQMGGAMPPQPCCGGIRSLLQQANNTPERRTICGCLKNVANGANGSGTYISRAAALPSKCRVALPYKISTNVNCHTIYLSDEGVLCASRARNACMGPCRKVIN

SEQ ID NO: 87139 - DNA, 806 bp, Zea mays
  misc_feature: Ceres CLONE 1574013
  misc_feature: Encodes the peptide sequence at SEQ ID NO. 87140
  misc_feature (751)..(751): n is a, c, t, g, unknown, or other
ggagctccccgcggtggcggccgctctagaactagtggatcccccgggctgcaggaattcgtctcacccctagaaaaagcgacctcagaatctcacggcatcacgcgaagcaaggagaaagaaaatggcgcagctggtggagacgtacgcgtgctcgccggcgacggaacgcggccgtggaatcctcctggccggggaccccaagacggacacgatcgcctactgcaccggccgcagcgtcatcattcgccgcctcgatgcgcccctcgacacttgggtctaccccgaccacgcctaccccaccaccgtcgcccgcttctcccccaacggcgagtgggtcgcctccgccgacgcctccggctgcgtccgcgtctggggccgctacggcgaccgcgcgctcaaggccgagtttcgccccctctcgggacgcgtcgacgacctccgctggtccccggacggcttacgcatcgttgtctccggggacggcaagggcaagtccttcgtccgcgcattcgtatgggactctggcagcacagttggtgagtttgatgggcactcaaagagggttctgagctgtgacttcaagccaacacgtccatgtcgcattgtgacatgcggtgaagattttctgggctacttttatgaaggaccgccatgtcaatttcagcattccataagggatcactcgaaattttgttactgtatcgggtatgctcctgatggtagtaagtttatcactgtgagttctgantagagggtttgatatatgatgggaaaactggagaaaaaataggagagctgtccac

SEQ ID NO: 87140 - protein, 208 aa, Zea mays
  misc_feature: Ceres CLONE 1574013
MAQLVETYACSPATERGRGILLAGDPKTDTIAYCTGRSVIIRRLDAPLDTWVYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPCRIVTCGEDFLGYFYEGPPCQFQHSIRDHSKFCYCIGYAPDGSKFITVSS

SEQ ID NO: 87141 - DNA, 1238 bp, Zea mays
  misc_feature: Ceres CLONE 1574016
  misc_feature (44)..(44): n is a, c, t, g, unknown, or other
  misc_feature (54)..(54): n is a, c, t, g, unknown, or other
  misc_feature (55)..(55): n is a, c, t, g, unknown, or other
  misc_feature (978)..(978): n is a, c, t, g, unknown, or other
gagggggaaagtttttttttttttttttttgatttgtttttgcncccactcgcnncgggggagggttttcaaactggagctcaccgcggtggcggccgctctaaactagtggatcccccgggctgcaggaattcgtctcacccctagaaaaatccgcaaacccctctcgatcgacacacgcagccgcgacccatcgagacctgacccgatcctcccgagggcgccagccttatcgctctccgcctcccgccgtcccccgcgaccctttgcaagcgcaaaaaaaaaaaaatgggccccgacgttcgggggccacttactaaagggggccctaaatggctggctccgaaacggagaaaaaatattccgcccttatagaggaaggagcacagttccggcaattcaaagccggccttaaggatgcttatacctacatacatggggatggggttccgcactacctaactaacccccccgtaattgtgtgggccaacaaggcggcggtatgaacgctactccgcgaaggtttacccctctggagaccaaggaaggaaaaatgagatttaaactcaccaggggacacacgaacggtcagggggccccgccccctgggtgttggttccgaacggtgggggcgtgttcacctctttgccccatctttccctgatggaaatcataacaaacggacacccctacaagggaaaaaacaagtggtggcgactccaaactatcgagacgccgaggccgaggggcgtggcccagttgaagggactcactcacgtaaacttactcaccttacgaaaaaattggtttacacaacaaacactcaaccatagttttgtatcagacgtgtcgcaatgcgagagttcgcgtagttcttttaacagtaataggattgtggggcaatgtgtacggcgtagatgagagctgcgggtggggcctctgtagcgcccatgtggttgcgtgatgtgtgatgcatcnccgggcgtattataattgtatgtaataacataacccggattatcttcatctaaaccagtgcgatagtgaagctgctaagaggtcaatatacatatctctcacttaataatgatagtgcgtagcggagagatagagtgcgtaagaatggaaacttcctactactaaaaatcaaacacaccaacattatcacataatattaatacttttacagtaagaatacataatatgccggtgtggccgtggcgaggatcctgatgaaa

SEQ ID NO: 87142 - DNA, 798 bp, Zea mays
  misc_feature: Ceres CLONE 1574020
  misc_feature: Encodes the peptide sequence at SEQ ID NO. 87143
  misc_feature (468)..(468): n is a, c, t, g, unknown, or other
  misc_feature (603)..(603): n is a, c, t, g, unknown, or other
  misc_feature (775)..(775): n is a, c, t, g, unknown, or other
tggagctccccgcggtggcggccgctctagaactagtggatcccccgggctgcaggaattcgtctcacccctagaaaaaaggaaagggaaaagcgggtcgcgagtcgcgactcgcgagtgcccgcttttgctccaatccaatcggtgccgcctcgggcgagatccgctccgcgtgccccgccgctgccgagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggagatggattctgtgagaagttggttccagaagttccagccgagagacaaatcgaagaggccagtggtggctgccagacatggaaaagatccaggnaaagccccgatggacgatgccccttctagtgcgacgaaacagagggttgccgctgcaaaaacagtacattgagaaccactacaagacccagatgaagtccctgcaagataggaaagagaggcgctggatgttggnagagaaattacaggatgcccgaagtccctgtagaagagcaaaataacattcttaagcatttggagaaaaaagagactgattatatgcgcttgcagagacacaagatgggaggttgaagattttgaactttttgactatatttgggagaagtgcatttcggaagaggtgcgtnctttgtagaagagaggtctctaa

SEQ ID NO: 87143 - protein, 54 aa, Zea mays
  misc_feature: Ceres CLONE 1574020
MDSVRSWFQKFQPRDKSKRPVVAARHGKDPGKAPMDDAPSSATKQRVAAAKTVH

SEQ ID NO: 87144 - DNA, 1144 bp, Zea mays
  misc_feature: Ceres CLONE 1574024
  misc_feature: Encodes the peptide sequence at SEQ ID NO. 87145
  misc_feature (54)..(54): n is a, c, t, g, unknown, or other
  misc_feature (55)..(55): n is a, c, t, g, unknown, or other
  misc_feature (57)..(57): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (891)..(891): n is a, c, t, g, unknown, or other
  misc_feature (1144)..(1144): n is a, c, t, g, unknown, or other
ctctgcttcctctttccttttggagggagggggaaggggagggacctactcttnntnttnggggaggnnnnggaaactggaactcaccgcggtggcggccgctctagaatagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagcccaccaggaggccgcccctgtgacgatcgaggacgtggacctcagctctcatcaggccgcggcccgaccgacgggggagctcgccagcgcgggtggctgggaggtctcacggcagcaaacaaactgggaaggggtctgcctgggacccccagtcaaacgggcagtgcatccctcccagggaaccttcatcccgacataccgagcgaagttttcgcccccaggggcccacccttaacgggagcaggcctttccggaaattaaccgaacccgggacctttccgttcacccccgcttaacctggtcggagggacaaggccatggcgccaaaggttaaacccccgttggcgggtaagaggatacctctttttgcatatacaccaacagtaagcgattccgggggcgccttcagagggnagggccactttccgggggcttaatcacaaggggtttcaccacccccgccgtgaacccttttctaaacagctcgagcgcctgtggcagaagcgaagcctgtgcaatagggttgtccccacaaaaccctttcccgggccaatatcataaataaagggggccactgccgacaaacgtacctaagggagtgtgttgggaagacagcaaaatacccctggtaaaattggattaaacgacagcggggatacgcctcggn

SEQ ID NO: 87145 - protein, 39 aa, Zea mays
  misc_feature: Ceres CLONE 1574024
  misc_feature (33)..(33): Xaa is any aa, unknown, or other
MAPKVKPPLAGKRIPLFAYTPTVSDSGGAFRGXGHFPGA

SEQ ID NO: 87146 - DNA, 855 bp, Zea mays
  misc_feature: Ceres CLONE 1574032
ggagctccccgcggtggcggccgctctagaactagtggatcccccgggctgcaggaattcgtctcacccttaaaaaaagaggagacatctgattcattttcagccgctcacaatctctttccatgttccgtattcgctgactgagaagaatacattgtcggtcaaggtgatggacgctgctatcggcatcgatcttggaacgagatactcttgcgtccgagattggcttccccagcgcgtacaaatctttgcggacaagcagcgtacacggcacccagccttcttatgtagatttgacggaggctcagggacttatcccacatgatcacgataacgtagttgacattagcgatatgaccagggggtttgatgacaaccctcttgtcggcactatgcttgccgatgctcctctccacagtgatactcaagtctgtggcctttacaggatctatctaggccgtggacagaatcacatgattgttctcgatcacaacggtgactgataatactttgcatctaataacatatgcggtctggctctgagtaccatgcctgagattcgtgatacttacctgaggagccgatcaaaaatgctgtggtgacattctctgcatgaccgagagactcagactacttggatgaagaggatcgtgacttcattactaggattaccagtgctgtcctactctcggaggagcagacgtactgtggctcacgggctatcggtctggaccagaacgttactaatcgtggggtgaagacgaatgaacgacagccttagatcttcgtagttcgggacgcttggaatgtctctgctccttaatcaattgggggataggactcttttgcaggtta

SEQ ID NO: 87147 - DNA, 822 bp, Zea mays
  misc_feature: Ceres CLONE 1574036
  misc_feature (822)..(822): n is a, c, t, g, unknown, or other
ggagctcaccgcggtggcggccgctctagaactagtggatcccccgggctgcaggaattcgtctcacccctagaaaaaaattctggaccacacataagctgccgccgccgttatgtttaccactggatgactgcaccagctgcccgccgactactccgtttcgcttcatagtacattgccgcgtcgaaggggaggtcctcaggagcaccggtggactccactcgcacgccatactcggcctactccgtcttcccctgtctagcagacagcctcttccccatctcgcttccgaatcttatcgtcgcctcgctcgacttcactgctgcgtccacgtgaccatggcactgcacgctccacggtcgtcgttctcaaggactcgatgaagcgggagtctggagcgaaggttcactaagccaacgtcaagacgggccgaggctgtcgctgacatcatacgcactacattgggtcccagagtccatgctgaaaatgcatctggatgctagtggagagtattgtggttactaatgataggtaatgccatttcgaggggaaatagacattgaacaccctgctgccgagtgtcttggatctactcagtcgtacacaggatgcagaagttggtgatggacactacttctgtacattcctctagcttggggagatgcaacatgttggcacggcatttctcgtcaagggactggcatccaactgggattgggccgagcagttaccaaaggcgctgtgatgatggctaattgctggtaaccgcactaaattcgcattggggggtggaatgtgaaatgaatggcggcggcaaatgtn

SEQ ID NO: 87148 - DNA, 1101 bp, Zea mays
  misc_feature: Ceres CLONE 1574037
  misc_feature: Encodes the peptide sequence at SEQ ID NO. 87149
  misc_feature (8)..(8): n is a, c, t, g, unknown, or other
  misc_feature (69)..(69): n is a, c, t, g, unknown, or other
  misc_feature (75)..(75): n is a, c, t, g, unknown, or other
  misc_feature (791)..(791): n is a, c, t, g, unknown, or other
  misc_feature (1009)..(1009): n is a, c, t, g, unknown, or other
aaatattnctaatatttatcaggaaataacagaaaaaaaaaacaaataaacttaaggttgggccggtcnaaaaanaaaaaaatggagctcaccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccaacaagtacaagagcttcatcgcttctgttcctgctggcttggtgagcaaagcggggggcaacagcagcggagatccccgtgctgggcgacgaagacaacccgcctcgcgctacaaatgcgtttctaaacatcccctcttgtagaacaaaggagagggccgcctccctaaaggctttgaagaataggatgtcctcccagaaagccctacctttccacgggccttaaccgtaatgcaaggggcaaaccgacttcggtggcccctaccctccaaaagaaaaatccaggggcggcggtaacagatttcttttccgtattgtgggctgaaaatcctggttttaaccgaacacgggtgggggncacctcgttggaggggaaaaacaaaaggttttctgggcattctctctggtaaaacaaaggggaaccccgtgtcttgcacctgaacatggcccggggctaaaacctgggactaaagggaaataccaccggggggggtccccacggggctaattgttgactaacagcgcggaacaataaatttctctcaaagacaaaggccccgaattccccgatttccncctagagttaccccaagagtcacccccacatcttgggcaaaaatctccttatcccgaaaagaaagagaataacgggaaaaacacggggacct

SEQ ID NO: 87149 - protein, 106 aa, Zea mays
  misc_feature: Ceres CLONE 1574037
MKGGTQAISLMVHLAVPWLCLASWAALLPALASGNVGAAAPILRADYIKLNFSTASATPNKYKSFIASVPAGLVSKAGGNSSGDPRAGRRRQPASRYKCVSKHPLL

SEQ ID NO: 87150 - DNA, 859 bp, Zea mays
  misc_feature: Ceres CLONE 1574051
  misc_feature: Encodes the peptide sequence at SEQ ID NO. 87151
  misc_feature (830)..(830): n is a, c, t, g, unknown, or other
  misc_feature (835)..(835): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
ccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggcctagatggcgacgccgaacgggcttgcgcggatctagacgaccgggaagaagaagcaggacaacggcgtgtggtacgacgacagctcggcgccagtgcgcgcgcagaccatcgacgagctgcactcgctgcagcggaagcggtcggcgcccagcacgcccaagcggtcggcgcccaccacgcccatcaagggcggtgcccactcgcccttcgccgtctcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatctacgccgagggggcaccagcagcaccgccaccacgccgccacccgcatcgccgtcagcgacagctcccttaagttcactcatgtggtcaacaaacctctcgcctgctgagctgtacgagcaggccatcaagatacccagaagggggtcggttcatcccgtccaccggggcgcggtgggctaccctgtccgggggccaagaccggggggggcctcccaaggacaccgtaaagacagtccggcggacttggggcaggccccaaccaatgaaaaacatctataagggaggcccgacctcacctggagggtttaacaccatgacaacgtagnttttngggaacctgatcaggtacgnnnnn

SEQ ID NO: 87151 - protein, 72 aa, Zea mays
  misc_feature: Ceres CLONE 1574051
  misc_feature: SWISSPROT Homolog: EC 4.1.1.49 Phosphoenolpyruvate carboxykinase (ATP)
MQSISASLASLTRETGPKVVKGDPAAKGEAAAQGAPSTPRGHQQHRHHAATRIAVSDSSLKFTHVVNKPLAC

SEQ ID NO: 87152 - DNA, 818 bp, Zea mays
  misc_feature: Ceres CLONE 1574054
  misc_feature: Encodes the peptide sequence at SEQ ID NO. 87153
  misc_feature (588)..(588): n is a, c, t, g, unknown, or other
  misc_feature (805)..(805): n is a, c, t, g, unknown, or other
ggagctccccgcggtggcggccgctctagaactagtggatcccccgggctgcaggaattcgtctcacccctagaaaagagcagccatgtagcaatttcaattgcaagttgcaacgcgacgaatacggagccatggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccttggtggtctcccgccacgtcctctccaccacctccacctccaggtcgtgccccatccccgtggccgccatctcggacggcttcgacgacggcgggatctcctcgtgcccggacaccgcggaatacgtgcgccggatggaggccgcggggtcggagactctggcggagctcctggacgccgaggcccgcgcggggcggtccgtccgcgtgctggtgtacgactcgcacttgccgtgggcgcgccgcgtggcgcgggccgccggcgtggccgccgccgcgttcatgacgcagatgtgcgcggtgggcctcgtctacngcgaggcgtgggccgggcgggtggccctgccgctggcggacggggccgcgctgcgcgggaagctcgccgtggagctgggccccgacgacgtgcccgcgttcgtggcggcccccgagtggtacccggcgttcacggagtccgcgctgagccagttcgacgggctggagcacgccgacgacgtgctcgtcaactcggtccgtgacctggagccaatggnaggggattacctg

SEQ ID NO: 87153 - protein, 229 aa, Zea mays
  misc_feature: Ceres CLONE 1574054
  misc_feature: SWISSPROT Homolog: EC 2.4.1.121 Indole-3-acetate beta-glucosyltransferase
  misc_feature (153)..(153): Xaa is any aa, unknown, or other
  misc_feature (225)..(225): Xaa is any aa, unknown, or other
MDDGAATTIVQGGDAHVLLLPFPGMQGHANPMLQLGRRLAFHGLRPTLVVSRHVLSTTSTSRSCPIPVAAISDGFDDGGISSCPDTAEYVRRMEAAGSETLAELLDAEARAGRSVRVLVYDSHLPWARRVARAAGVAAAAFMTQMCAVGLVYXEAWAGRVALPLADGAALRGKLAVELGPDDVPAFVAAPEWYPAFTESALSQFDGLEHADDVLVNSVRDLEPMXGDYL

SEQ ID NO: 87154 - DNA, 784 bp, Zea mays
  misc_feature: Ceres CLONE 1574056
  misc_feature: SWISSPROT Homolog: EC 6.2.1.12 4-coumarate--CoA ligase
tggagctccccgcggtggcggccgctctagaactagtggatcccccgggctgcaggaattcgtctcacccctagaaaaaacgcacgcgcgcgcgctccctcgcctacctccggtccctgcccgcctgttgctgtatttatttccgcctcgtctcttccccatctcgacagcatcactgccgtgtagtgtagctagagcccctgcactggtccggattcgcagagcaaaacggaaatgatcactgtggcagcaccggaggcgcagccgcaagtggcggcggcggcggttgcggcgccggaggagaccgtgttccggtcgaagctgccggacatcgacatccccacccacctgccgctccacgactactgcttctcgagggccgcggaagccgccggcgccccgtgcctcatcgcggcggccacggggaagacctacacgtacgccgagacgcgccttctgtgccgcaagggcgccgcgtgccttcacgggactccgcgtcgcccagggcgaacgcgtcatgcttctgctccagaacttcgtccagttcgtgctcggcttcttcggggcgtcccttcctcggcgccgtcaccacagccgcccacccgttctgggagccgcaaggaaatcacaaagcaaattaacgccttcggggccaaaaggtcttcttcacccattccgcctacgtcgccaagctccggcacgaacgctttccggaaggatcggcgtggacggcaatgccctcaccgtcctcaccatcgacggcgaaccggccaaaaccccggac

SEQ ID NO: 87155 - DNA, 888 bp, Zea mays
  misc_feature: Ceres CLONE 1574060
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (847)..(847): n is a, c, t, g, unknown, or other
  misc_feature (848)..(848): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
ccccgcggtggcggccgctctagaactagtggatcccccgggctgcaggaattcgtctcacccctagaaaaattgttagggcccttcggtgagcaatataatacgacttgcgctaccaaagcgtccataggtgtgtctttcctcactgaaaactttttttataaaactatccttaatacatgatcagttggtgacaaaatgcttcaagcattgttagtttcgaaccagacctatctgtagatgtaattcaagttttctaccacctgtacctactaatgcagataaaagaaaaaccggctcacattcctatatcatatgcatgaaaactgttccatgtattttcacaaagctagagtgtggcatgttttacatctattataacggtctaccatttttgggcccatctataacaaggacttgtcccctgctagtaaatgaaaatgtttgtcactaaggttgagtccagtgcacagccatctctctcaccctggcacgttagctctcgcctccactctcgcccctgatgcttcagtgcacaggctgcagcaggctacagcctcaggctatagcaacgtgggaacaatcaaaaacggccactaatggtggcccctcgttttggccggtaaaagacgcattgtaaaaagcgtcgccccactccgcctgcataaacgggggaaaagtagggcggtgagtataccgctcaggcattcttaggaaagtacgggcccaaaccaagctcaggattaatatcccccaaatgtgtgagggtacattccaaccgccatttatcatattttccagggccctccttgacccccccagtatattgagcnnnnnnnngtggggnngtgtgttnnnactttcaaaaaggcgggtgtggaccctgtt

SEQ ID NO: 87156 - DNA, 1016 bp, Zea mays
  misc_feature: Ceres CLONE 1574061
  misc_feature: Encodes the peptide sequence at SEQ ID NO. 87157
tccccgcggtggcggccgctctagaactagtggatcccccgggctgcaggaattcgtctcacccctagaaaaaacacaacccaaagcagccacagcagcctccttcctggcttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtgcgtcaagtacaacttccggaccagaaccgccgtccccaagctcggggtgatgcctgcggggtgggggagcaacatacgggtcccacgctgaacgggccgggggtctttggccaaccaggggagggggatcttcatgtgccgaacccaaaggacaaagggtggcagcgaagggcaaacttacttaggggcttcccttttccccaggggccctgccaaccattaaagaaggtcggggcagccctcattaacgggggggaaagggaaaattctatttccccgccccgggtctaaaataagccctacccactttgccccaatggggggtgtaaaaaccccgtgaccggaacaatttttggtggttttccgggaaggggccttgggaggaacactttttaggcccgaacactggaaatctcttggggacccagaaatttcccaaggagaacaagaggggcccacaaaggtgtccctggggagatattttgacccctctggcgaaaaaagacatccctctaggggccccctaagaaggatgagaggcccacttgggggggcccaattgtgtccgggcggaataactatattatttccaacacacttctctcccgcgcggccttaaacaagggggttctctcttcaccccaaaaaggggtggcttttccatgggggacacc

SEQ ID NO: 87157 - protein, 77 aa, Zea mays
  misc_feature: Ceres CLONE 1574061
  misc_feature: SWISSPROT Homolog: EC 5.5.1.4 Inositol-3-phosphate synthase
MFIESFRVESPHVRYGPTEIESEYRYDTTELVHEGKDGASRWVVRPKCVKYNFRTRTAVPKLGVMPAGWGSNIRVPR

SEQ ID NO: 87158 - DNA, 802 bp, Zea mays
  misc_feature: Ceres CLONE 1574066
  misc_feature: Encodes the peptide sequence at SEQ ID NO. 87159
tggagctcaccgcggtggcggccgctctagaactagtggatcccccgggctgcaggaattcgtctcacccctagaaaaaagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgttctccatgtgctctcatcttgtgatctaggtccgaaagatctcgccaatctggaggctacatgcgtatttttcggcaaacctgcaagttttgcaccagactttgcattgtcacttccggagctttgcgcatttgatatgtgccagaaaaggaccatgtttaagcagatgaagcaagaggatcaggagtgtctgaaacaacggtgtgggaggctccttggaacatggttcttgggtaacatcctggttaggggaaaaaaaatggttcctcgggggaattgccggggccaaggcccttaacctcccttattccccccccaaaatggggaatggttttttttcccttttggggaagaaaaactgggcttcccgggtccaacct

SEQ ID NO: 87159 - protein, 155 aa, Zea mays
  misc_feature: Ceres CLONE 1574066
MDTAASGTSPVMQFHSNADESIAHSSPLATLIQRSQRHCYGDGSPGEFPLAVSPSIVLHVLSSCDLGPKDLANLEATCVFFGKPASFAPDFALSLPELCAFDMCQKRTMFKQMKQEDQECLKQRCGRLLGTWFLGNILVRGKKMVPRGNCRGQGP

SEQ ID NO: 87160 - DNA, 825 bp, Zea mays
  misc_feature: Ceres CLONE 1574067
  misc_feature: Encodes the peptide sequence at SEQ ID NO. 87161
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (817)..(817): n is a, c, t, g, unknown, or other
  misc_feature (821)..(821): n is a, c, t, g, unknown, or other
  misc_feature (824)..(824): n is a, c, t, g, unknown, or other
  misc_feature (825)..(825): n is a, c, t, g, unknown, or other
ggagctccccgcggtggcggccgctctagaactagtggatcccccgggctgcaggaattcgtctcacccctagaaaaagtcatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaagacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggtatcttcgacgccgacgtcaagcccgtcggcgacaactccatctccgtcgacggcaaggtcatcaaggtcgtgtccgaccgcaaccccagcaacctgccgtgtggcgagctcggcatcgacctcgtcatcgagggcaccggcgtcttcgtcgactgcgagggcgcagggaagcacatccagacgggggccaagaaggtgctcatcaggcgcggggagggaaatcccactagtgtcgctaggaaggaccgagctaatttaaattgtgcaacgcacgtaggctnnnnnnaacttaactctccatcagcttagtccaatctctgctaccacatcgcagtggcgcggccccnaccngcnn

SEQ ID NO: 87161 - protein, 222 aa, Zea mays
  misc_feature: Ceres CLONE 1574067
  misc_feature (68)..(208): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (214)..(214): Xaa is any aa, unknown, or other
  misc_feature (215)..(215): Xaa is any aa, unknown, or other
  misc_feature (216)..(216): Xaa is any aa, unknown, or other
MASSMLSATTVPLQQGGGLSEFSGLRSSASLPMRRNATSDDFMSAVSFKTHAVGTSGGSRRAPTEAKLKVAINGFGRIGRNFLRCWHGRGDASPLDVIAINDTGGVKQASHLLKYDSTLGIFDADVKPVGDNSISVDGKVIKVVSDRNPSNLPCGELGIDLVIEGTGVFVDCEGAGKHIQTGAKKVLIRRGEGNPTSVARKDRANLNCATHVGXXXLNSPSA

SEQ ID NO: 87162 - DNA, 901 bp, Zea mays
  misc_feature: Ceres CLONE 1574068
  misc_feature (480)..(480): n is a, c, t, g, unknown, or other
  misc_feature (508)..(508): n is a, c, t, g, unknown, or other
  misc_feature (526)..(526): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (571)..(571): n is a, c, t, g, unknown, or other
  misc_feature (613)..(613): n is a, c, t, g, unknown, or other
  misc_feature (619)..(619): n is a, c, t, g, unknown, or other
  misc_feature (620)..(620): n is a, c, t, g, unknown, or other
  misc_feature (639)..(639): n is a, c, t, g, unknown, or other
  misc_feature (660)..(660): n is a, c, t, g, unknown, or other
  misc_feature (708)..(708): n is a, c, t, g, unknown, or other
  misc_feature (711)..(711): n is a, c, t, g, unknown, or other
  misc_feature (715)..(715): n is a, c, t, g, unknown, or other
  misc_feature (716)..(716): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (788)..(788): n is a, c, t, g, unknown, or other
  misc_feature (793)..(793): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (855)..(855): n is a, c, t, g, unknown, or other
  misc_feature (866)..(866): n is a, c, t, g, unknown, or other
  misc_feature (873)..(873): n is a, c, t, g, unknown, or other
acccgcggtggcggccgctctagaactagtggatcccccgaggctgcaggaattcgtctcacccctagaaaaaggtcagaatgctgccagattccgaaacatgtccctagccttatcagctccaactccaaagcgcttgcttcgttgcgctgccgggaactgtggccaccgggcccgccgccggacccccggtgttctcctcgccggcgatgtcggcgccgcctgtacgtacgctcgccgaccttgatggacaacgtgttggatcactgcgccggctacctcggcgcccgcgacgtcgcagcctcgtccatggcctgacgccccctgcgcgccgccgcctattgcgactcggtctgggtaccgccctctttcaggggatacactcggcccatttttcaataacccccccccccccccggggggaaaagaactcttttttttggggggcggcggcttacttaaaaagacaaaaagtacttnatcccactccaccaccaccattactaanaataccaaaagaccccantacgccgttgtttctcgttaaggggtaccagagaaaacgnnnagncgcaattattatcccccgcaacccactcgctcaggagggcangtcccnncccaacctcttgtctgcanagatagaacggcggacgaccnacaccacacgcaaaccaactgcgcagtttcaacgtcttgcctcgacgntcncagnngggnnnttttttgtttgtttgtggattttaaaacaataccacacatgggccctcaccccttccacaaacaancaccncaactcgtctattttgttttttgggttgatgnnnttgttgaacggtacgacaggttgttgtngtggccacccngatgttncaaagagtaaaacaacaaaaagacaaag

SEQ ID NO: 87163 - DNA, 665 bp, Zea mays
  misc_feature: Ceres CLONE 1574069
  misc_feature (242)..(242): n is a, c, t, g, unknown, or other
  misc_feature (260)..(260): n is a, c, t, g, unknown, or other
  misc_feature (264)..(264): n is a, c, t, g, unknown, or other
  misc_feature (290)..(290): n is a, c, t, g, unknown, or other
  misc_feature (421)..(421): n is a, c, t, g, unknown, or other
  misc_feature (422)..(422): n is a, c, t, g, unknown, or other
  misc_feature (444)..(444): n is a, c, t, g, unknown, or other
  misc_feature (468)..(468): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (576)..(576): n is a, c, t, g, unknown, or other
ggagctccaccgcggtggcggccgctctagaactagtggatcccccgggctgcaggaattcgtctcacccctagaaaagtccctgtcaggcctgctaagctccagccaaaaaatcgttggcctcggtctggtgcctgctcctcctgccgtcctcgctcctccccacctcccgcggcctcccacgcgacatgattgcattgcgggctgccgcggagctcagctctcctgtcctgccaccaccnacgccgctgacgatgccnttcntcttcgcctgccttctgcccttgggnaacaaacgaaacggtagccggccttcctcccttccccttttgttttcccaaccaaaaattggggggggggggtttcctttttttccgaaaaaaaaagggtggaaaaaccccccgggggtgtttttgttttnntggggggggcgccccctgggcnaaaaaaaaaaaaatttttaaaatnggggggggggccgcccccccttctttttccccaaaaaaaaaaacagcnnanaaattctacaagcnnnnnnaaccnnnttccctttttcccctccccttccttnnnntngcccccccccccccccgggggggggttttttttttttaaaaaaaaaaaaaaaagaggggggggcgcccccccccccccccggaagaaag

SEQ ID NO: 87164 - DNA, 1203 bp, Zea mays
  misc_feature: Ceres CLONE 1574071
  misc_feature: Encodes the peptide sequence at SEQ ID NO. 87165
  misc_feature (14)..(14): n is a, c, t, g, unknown, or other
  misc_feature (59)..(59): n is a, c, t, g, unknown, or other
gtaaagaaatacanaaggcgagagaaaggagaataaagcaagaggggcggcgctctttnttgttgttattatagaaactggagatcacctcggggcggcctctctagaactagtggatcccccgggctgcaggaattcgtctcacccctagaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcacccgttttgacaagaagggtttctacctcaaggcctatgaagctagtcaacgtagaataagttattagctgacaaacaatacaaaagatctcacctccagagcccctccatccagggtcccacaaaacaaaatcaaacaataggccctaatatcgcccacaactacatgggaagcgcacacaacgatcttcacgaacctggcccgaaagggaacaataggtcaacccaaccataccccacctggtcttcaccaaccccccaggacaacgagacaccaggggggaaaacttcaatatacatactacaataaacactagacatttggcgatccacacaagctataatcctaccaatcataattagaacaaacagccttaacacaaaatagatggaatagacccccgtattgcaacgacaaagccaaccctaaactatattctcttccctcaggcggtgaaaactaacagaatcaaacaaattatcatcgtcacaaatgtctacacacacaccacgagagatcaagtcaccctccgtgcgataatatacaacaaaatacatcatttacacgcgtatgaacaataattcttcaccatattcactctagatcaacaccactgatgacgaaaataccaaaaaacaataaaaacagcttcgtctctgcctagttcctaccactatattcacccgctcagttatacaactacacaaacagaaagaacacggcgccaaggaactgcatacacattaaatgacatctccacaccaccttcacaaggacaacagcccacgcagacaatcacactaaatcagcgcagagaaaaaacgctctacgcatagacatccaacgatcctagttgcatcgacagatctaccccattcacgacacgtttacaagtatctctcttgctctgtcccag

SEQ ID NO: 87165 - protein, 44 aa, Zea mays
  misc_feature: Ceres CLONE 1574071
  misc_feature: SWISSPROT Homolog: EC 2.7.4.6 Nucleoside-diphosphate kinase
MESTFIMIKPDGVQRGLIGEIITRFDKKGFYLKAYEASQRRISY

SEQ ID NO: 87166 - DNA, 833 bp, Zea mays
  misc_feature: Ceres CLONE 1574072
  misc_feature: Encodes the peptide sequence at SEQ ID NO. 87167
  misc_feature (619)..(619): n is a, c, t, g, unknown, or other
  misc_feature (731)..(731): n is a, c, t, g, unknown, or other
ggagctccccgcggtggcggccgctctagaactagtggatcccccgggctgcaggaattcgtctcacccctagaaaaaactgtggcacagtgcacacactcgtctcatcggagaaaagtagatccgggttagggttttagacggcgatgggtgcggcgggcgacgagaaggctgcgatggctgcgtccgctgcagccgcgggggccggtgccgccgagggcgagggcgcggtggactccaaggaccttcagcagcagagcaaggcgctcgacaagctcactgatcatgtcgaggaccggcagctcgattcatcccgtgtccaatccgccatggcggcacttgcttcatccaaggaggctgactggaacgcgatgaggctgagggagaaagaattggctgctgtcaagatcaaccctgccgatgtcgaaattatcgctagtgagcttgagctggacaagaagatcgcggagagaacgctccgtgagcacaagggtgatgccgtggctgcggttcgattcctgctgcgctagttccgagatttcgtcgccagcatcacatgttccccttcagttccacacaagaggtgatgatgtgaagcactagtacttttatctgtgtngcctgttttggaagtttgctattagaactatgttgcagaaaattaagaatgagataccatgcaaaaggtgtaatatgatttggtattaaattattgctattagaactaattnaatcattatcccctttgccacttctacagcccctctgctgcagcaagaaggaaagagctagcgcttatagcttgtcagccatggcaaccgccgccgcgtctt

SEQ ID NO: 87167 - protein, 127 aa, Zea mays
  misc_feature: Ceres CLONE 1574072
MGAAGDEKAAMAASAAAAGAGAAEGEGAVDSKDLQQQSKALDKLTDHVEDRQLDSSRVQSAMAALASSKEADWNAMRLREKELAAVKINPADVEIIASELELDKKIAERTLREHKGDAVAAVRFLLR

SEQ ID NO: 87168 - DNA, 824 bp, Zea mays
  misc_feature: Ceres CLONE 1574075
  misc_feature: Encodes the peptide sequence at SEQ ID NO. 87169
  misc_feature (728)..(728): n is a, c, t, g, unknown, or other
  misc_feature (754)..(754): n is a, c, t, g, unknown, or other
  misc_feature (771)..(771): n is a, c, t, g, unknown, or other
ctccccgcggtggcggccgctctagaactagtggatcccccgggctgcaggaattcgtctcacccctagaaaaagcatacttgcagctcgcacatctcatggtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccgggtcgcggccaagctcccctgggaagagaccctgtcgttcggctacacgacggcgccgcgtcgcctgtcgtcgtggactacttcgtcggcaccctcggncaggattcgagccaatgggggtgggntgtacaaaagtactgcnaggagatgaaggagctgtccctgacaatcatggagctgctggagctgaacctg

SEQ ID NO: 87169 - protein, 202 aa, Zea mays
  misc_feature: Ceres CLONE 1574075
  misc_feature: SWISSPROT Homolog: EC 1.14.11.15 Gibberellin 3-beta-dioxygenase
  misc_feature (186)..(186): Xaa is any aa, unknown, or other
  misc_feature (195)..(195): Xaa is any aa, unknown, or other
MDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRVAAKLPWEETLSFGYTTAPRRLSSWTTSSAPSXRIRANGGGXYKSTARR

SEQ ID NO: 87170 - DNA, 798 bp, Zea mays
  misc_feature: Ceres CLONE 1574079
  misc_feature: Translation starting site: 260
  misc_feature: SWISSPROT Homolog: EC 2.7.11.1 Non-specific serine/threonine protein kinase
ggagctccccgcggtggcggccgctctagaactagtggatcccccgggctgcaggaattcgtctcacccctagaaaaaacaaggtgcacattccctcgtgacggagcagctgcctgcctgctgcgaggagccacccagatcttcctcgccccatcagacgtttctggagatccttttcacttgcaccaccagggtacatagaccgcatctgcgagtgctgtgcactcctcagactcaacttgttggttcatccatccagatgccgacggagaccggaggtcgatcaactacctatatgaccgagcgtggaagctcccggaccggacattccattttccgttcagataggggggtgagaaggcggggaatgagtacaagcaaggtgaagagacgtgtgggcaagtatgagctcggacggaccataagagagggcacattcgcgaacgtcaggttcgcgagggacaaaggcaccgcgctagccgtggccattacgatcctggacaaggagaaggtcctcaagcacaagatggttgagcaaatcaagcgggagatctcgacgatgaagctgatcaagcactctaacgtcgtcagcatatacgaggtgatgggaagtaaaacgagatctaccttgtgttagaattcgctaccagtggcgaactctttgatacaattgttaaacatggtcaaatgagggaagacaaggcaagaatgtacttcccaccagtgaatcaagtgcagggaattattgccaagagcagggggtgtgtaccaaccgaggaatttaaaacctgaaaaatt

SEQ ID NO: 87171 - DNA, 1314 bp, Zea mays
  misc_feature: Ceres CLONE 1574081
  misc_feature (50)..(50): n is a, c, t, g, unknown, or other
  misc_feature (1100)..(1100): n is a, c, t, g, unknown, or other
  misc_feature (1239)..(1239): n is a, c, t, g, unknown, or other
  misc_feature (1275)..(1275): n is a, c, t, g, unknown, or other
ccctccccccccttccccccttcttttctccgggtttatcttaaaccacnacgggagaactaccacaataaaagtggagctcaccgcggtggcggccgctctagaactagtggatccccctggctgcaggaattcgtctcacccctagaaaagttcctgcctgtctgtcgcctcgtgacgtctgtccaagaacactcgctccccacctgttcgctgcttcttcttcttgccaaactgctcctacttctagctagatcttggatggagctggggatgacaatggaggtagcgaagatcatcgaggtatgtagagtacacggctgcgatttagttcaccaggccagcaagcgagctccagcttcctccgatcgatagatgcgagctgaaccaacttggcagccattcatcgatggtcaggatcttgaattccccccatcccccgctacaaggtgggtggttagccatccccccccagcaggaaccaccccgccaggaaagcccctggccaatggattccccgttttaaagggtggccccctggggcttcggggagctatttgccgtattttccggcggggcatggggcgggggttccccggtgggatgccccatttcctcgccccctgcagatatgcccctgagggtcggctccccccgttgcgggggggacaacccatggcccttaatggggtgccccttcttccgggtgctgctacaattgaataatatgcgttaaaagaaaaacgcgccaagaggggctggcacaagtggtgggatatacttgggcgcacccttattcgcggaggaggacgccgcgctctccggtatattccgcggcgagcccactatctgcggttgatgtgtgatggatatgccccggagataattatatgtggatagagttttatactcctatatacgggtagtgattatcaggcgggccaatattcatggtggagggagccagccccgattcatttttgtattttcgctgtgactggagtaagaaactacgagatggtggtggggcggggaagaaatataacactgtctcgtggttatggttctctgcgtatatcggcctccacctcgacaggcangctctacgacggtaccatcccgccccacatgatacagaccgttcgtttttgtgtatataccaagacacccctataattattctaggtcccttcatatgtcgatgatcattctaaagagtgtgactcatattaatacccncacaaaagcacgcggctcttctcgatatacgagttntatgcaggtgtcgagcccgtactgctatataccactgaa

SEQ ID NO: 87172 - DNA, 831 bp, Zea mays
  misc_feature: Ceres CLONE 1574083
  misc_feature: Encodes the peptide sequence at SEQ ID NO. 87173
  misc_feature (625)..(625): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (772)..(772): n is a, c, t, g, unknown, or other
  misc_feature (819)..(819): n is a, c, t, g, unknown, or other
tccccgcggtggcggccgctctagaactagtggatcccccgggctgcaggaattcgtctcacccctagaaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttcaccagggcgactaccanctcccgctccgcaagctcgtccagggcgcgctcggccccgacgcgctgcgcgcgctcgttcttgaagtggaggcngnncgtgcgtccactctcgcttcctgggggacgcggcacgtcagaagcacgttccacgccatgaagacgctngtcgtttgacgtgggcatcgtgacgatcttcggcggccggcttgacnaagtggcgcaag

SEQ ID NO: 87173 - protein, 178 aa, Zea mays
  misc_feature: Ceres CLONE 1574083
  misc_feature: SWISSPROT Homolog: EC 1.14.13.93 (+)-abscisic acid 8'-hydroxylase
  misc_feature (133)..(133): Xaa is any aa, unknown, or other
  misc_feature (158)..(158): Xaa is any aa, unknown, or other
  misc_feature (159)..(159): Xaa is any aa, unknown, or other
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFFTRATTXSRSASSSRARSAPTRCARSFLKWRXXVRPLSLPGGRGTSEARSTP

SEQ ID NO: 87174 - DNA, 832 bp, Zea mays
  misc_feature: Ceres CLONE 1574085
  misc_feature: Encodes the peptide sequence at SEQ ID NO. 87175
ctggagctccccgcggtggcggccgctctagaactagtggatcccccgggctgcaggaattcgtctcacccctagaaaaagctgcgaactcactcaaatcccaaatcaaatcgactccccagcctgaactgtcctctcctggactcccctcgccatctatcaacgcgacaacgcccgccaccccgccagaggaggatcccggcctcccggtgccgggagccaagccaagccacgcaccggccggccgcggcggatcgggacctcccctgccgcccgccagccgcatttgaggagggcgatgtggcgcctgcggatcgcggaggggggcggggacccctggctacgcacgaagaacgcccacgtcggccgccaggtctgggagttcgacgccgccgccgaccccgaccccgccgtcgacgccgcgcgccgcgccttcgtcgccaccaggggccacctcaagcacagcgccgacctcctcatgcgcatccagttcgccaaagaaaactcgattgagcttcaccttcccggcatcaagctcggtgagcatgaagatgtgaccgatgaagctgtgttgactacattgaaaagggcaatcagccgtttctctactctccaggcacatgatggacactggcctggggattatggtggtcctatgttccttatgccaggcttgatcataacatttgtattgtgactggagcactaaacactgtcttgtcattggaacaccagaaggagatccgcccggtatcttttataatcaccagaattgaagatgggcggctgggggcgttgcacattggagggttccaaagcactatggttcggt

SEQ ID NO: 87175 - protein, 132 aa, Zea mays
  misc_feature: Ceres CLONE 1574085
  misc_feature: SWISSPROT Homolog: EC 5.4.99.8 Cycloartenol synthase
MWRLRIAEGGGDPWLRTKNAHVGRQVWEFDAAADPDPAVDAARRAFVATRGHLKHSADLLMRIQFAKENSIELHLPGIKLGEHEDVTDEAVLTTLKRAISRFSTLQAHDGHWPGDYGGPMFLMPGLIITFVL

SEQ ID NO: 87176 - DNA, 1198 bp, Zea mays
  misc_feature: Ceres CLONE 1574086
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (59)..(59): n is a, c, t, g, unknown, or other
  misc_feature (61)..(61): n is a, c, t, g, unknown, or other
  misc_feature (67)..(67): n is a, c, t, g, unknown, or other
  misc_feature (831)..(831): n is a, c, t, g, unknown, or other
  misc_feature (903)..(903): n is a, c, t, g, unknown, or other
  misc_feature (905)..(905): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (975)..(975): n is a, c, t, g, unknown, or other
  misc_feature (976)..(976): n is a, c, t, g, unknown, or other
  misc_feature (1037)..(1037): n is a, c, t, g, unknown, or other
  misc_feature (1055)..(1055): n is a, c, t, g, unknown, or other
  misc_feature (1084)..(1084): n is a, c, t, g, unknown, or other
  misc_feature (1089)..(1089): n is a, c, t, g, unknown, or other
  misc_feature (1099)..(1099): n is a, c, t, g, unknown, or other
  misc_feature (1127)..(1127): n is a, c, t, g, unknown, or other
ggattnnnnaacaaaccaccagatttcccagacctacaacactacaccaataccgggcntncttttnttttaaaagctggagctccccgcggtggcggccgctctagactagtggatcccccgggctgcaggaattcgtctcacccctagaaaatttaataccgtgtgcatgagatatggcacgcgttcttgctcaactacatcaccatggcaatgtctgcaaatccatggattgatggatggatgttggttgtttcttaacattctggacattttcactttggctatgtatgttttagcagtccagcgttccccttacaaaatatggcgtgctttgttgactaaaaaaaaaaacaaacgccacttgtttcagtccagatgtttggaactaacactctatcagaagaccagtaaaatgtccttgatgtcagatggaaacgaatacaatcaaggcaactacctcagaagaatgtgcatggctaacccccccctgttttgccattaaaaaaaaggtttcaagctttaaaaggatggcattgcgaaaaaaagaaaaaccgccccgtaagtttttaccccctccagggttggggggttgggccccccttttttttggaagggaagcccgtttctttgggtggcaaaaaaaaatacccctcttcccccacaaaatgtttcccgcgggaaatttatcacgcgggttccccccccctctcgcaaacaacatctttgtaaagcctcctgcgtattgagattccctacccgaataaggcgcggcccccgcgggttattattctcttctcaacacaacgaaataatacgtttgtggagggncgccacgggagaatacaaaatgttgtctcccgcgggccttccctctttcctacagagtagttgctgaatttnangtnnnccgaccaaccacacaccatcacccacatgacagccgccgcgcgcgatctgtttcatatatagctnngcacactattttattttcattaaacaggaacctcgtcctctgaatcctcccctacacaccnccggggtgttgtctgcanaggcttattcttctaagaagagcgcgtancgatntacatagggncgaggcggtgggtgaacatctacgcccnacatataacggcggactcgagggaaacgcagagtcgcgcagtactacacccacaccagatagcgcgatcgt

SEQ ID NO: 87177 - DNA, 792 bp, Zea mays
  misc_feature: Ceres CLONE 1574088
  misc_feature: Encodes the peptide sequence at SEQ ID NO. 87178
  misc_feature (792)..(792): n is a, c, t, g, unknown, or other
ctccccgcggtggcggccgctctagaactagtggatcccccgggctgcaggaattcgtctcacccctagaaaaaccccagtgacccagttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacggcggaggagagagccccgaaaagggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcgggccttagacgtcatggaccgctacggcctcaagcacgacgccgtcgcgctcn

SEQ ID NO: 87178 - protein, 158 aa, Zea mays
  misc_feature: Ceres CLONE 1574088
MITAEERAPKREEEEEANPRAEAFLEIICRVPAGEVEAALSACGIGPTAEVEELVLKSRECYKRPKSAVRFFRWAGQSVSHTAYAWNLLVDILGKAAMFEPMWDAIRSMKQEGGGGLVSVATFASVFASYCAAGNIKDAIAGLRRHGPLRPQARRRRA

SEQ ID NO: 87179 - DNA, 810 bp, Zea mays
  misc_feature: Ceres CLONE 1574089
  misc_feature (580)..(580): n is a, c, t, g, unknown, or other
  misc_feature (581)..(581): n is a, c, t, g, unknown, or other
  misc_feature (592)..(592): n is a, c, t, g, unknown, or other
ctggagctccccgcggtggcggccgctctagaactagtggatcccccgggctgcaggaattcgtctcacccctagaaaaatcctccacgcgaatccgcatctccagactccaaccagcgctcgtccctccccgttctttcctcctcccttcagccatcgcagtcgcagcgcaggttcttggctggttgctggtgtcgacagcaaagtccgcaactccaatcctgcctgcgctcctcccgtcctcactcagcacccgcgcacgccgcctgcctgtcgattgagatctctttcacgcccctttctgccatcgcacaactgaggtacggttctttgcttattgcagagtatagtatggatgcccgcagtgagtcgtcgtgtcgtgccttcagtaggaggtacggtacttgtgctgtaggagcagttcataagtcgccacactgttttcaggaaatgacagtctttgtgtgtgtatttcatagatctagagcattcactgtcttgtccctttgcagccgcagctacgatactattaacatcaatttgtctggtcaataaatcactcggagcaatcgtgcgagtnncttgtgtgtgntattcattgatctcgagcactcactggttttgtgcctttgcagccgcagctagtaaacatcatttttgctggtccaataagtcgtggggaagaaagaggatggatttatttgaaaggtgcaggtgggtaaaacccatcaatttgtaagtgcccaaagcgaagccaaccccaacaaaagcgccctgggctccccttggttgggaaaaggggtccaagca

SEQ ID NO: 87180 - DNA, 833 bp, Zea mays
  misc_feature: Ceres CLONE 1574104
  misc_feature: Encodes the peptide sequence at SEQ ID NO. 87181
ccccgcggtggcggccgctctagaactagtggatcccccgggctgcaggaattcgtctcacccctagaaaaagtcgttctctcacaaactggcattcgatttcgcagcccaccagctccggtttcttccgactgcgagcttccaagtggcgactgcccgagtgcgagaagagggagagaagcggttgtcggaatccactccggccaggggtgcggaggtcggaatggggggaggattggatgaggcggtgaagggtggtgggatttggaggacggtgaaggggaggaggaggcagaggccgccgcggcggagggatcgagcatggagatggggatgctgccaaggatgccggtgcgtgtgctgctcgccgaaggcgacgactccacgcgccacgtcatctccgcgctgctccgcaagtgcggctaccgagttgctgcagcctcagatggtgtgaaggcgtgggacctattaaaggaaaaatctttcaaggtagaccttgttttaactgaagttgaactgcctttgatgtctgggttcctcctgttatccacgatcatggaacatgatgcgtccaagaacatccccgttataatgatgtctttcgcatgactccgtaagcatggttttcaaatgcatgctaaagggtggagcagattttcttggttaggccgataagaaagaatgaattaaggaaacttgtggcaggacgttttggagaaaacaactggccaaacggggggccctaaagtttcggcccctacaaccgagaagaggaatcttggcgaaaagaaatccacccaaaggaagtggtggtgcccaaaagcttgaataag

SEQ ID NO: 87181 - protein, 95 aa, Zea mays
  misc_feature: Ceres CLONE 1574104
  misc_feature (11)..(95): Pfam Name: Response_reg Pfam Description: Response regulator receiver domain
  misc_feature: SWISSPROT Homolog: EC 3.1.4.17 3',5'-cyclic-nucleotide phosphodiesterase
MEMGMLPRMPVRVLLAEGDDSTRHVISALLRKCGYRVAAASDGVKAWDLLKEKSFKVDLVLTEVELPLMSGFLLLSTIMEHDASKNIPVIMMSFA

SEQ ID NO: 87182 - DNA, 811 bp, Zea mays
  misc_feature: Ceres CLONE 1574105
  misc_feature: Encodes the peptide sequence at SEQ ID NO. 87183
agctccccgcggtggcggccgctctagaactagtggatcccccgggctgcaggaattcgtctcacccctagaaaacatgggccactactgctagtgctagtgctagtagcagcggcacagcgcggagaggcagagaagtagccaaagccaagtaggaggaggaggaggaggcagggcgcggggcgagagcttgacgcggcaaccaccgctgcactgcactgcacccctcgctcctccgagctcagcagcagcagcagcagcagctcgctcgcggcatgtcgccatccatgtcaggaaagatttatctggtcggccgatcgagctcctctcctccgaagcactgaagctccagcggctgccctgcctgacagccactccgcacgacaaaattaaacgcgggcgatcaagatggcgcacgaccccagcctgggcttcgcggactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaaggccggtgcgctcctcgacgacgacgacgcgggggtggggccagacgtcagcggcttcgcggacgacgccaccatgcgcttcctgagcgagcagcagcagcagcaccaccagggcgccgctgtcgctgtcgctgtgcccgcccgaacgtggcgacgactttgcacgaacagaaacacctcggcggcggtggctcctt

SEQ ID NO: 87183 - protein, 134 aa, Zea mays
  misc_feature: Ceres CLONE 1574105
MAHDPSLGFADYFSAAAAAGATAMDDDVGAPELYGLHADDMEFLGMRGLAAMPPAAAHHQHHHHHGHSKAGALLDDDDAGVGPDVSGFADDATMRFLSEQQQQHHQGAAVAVAVPARTWRRLCTNRNTSAAVAP

SEQ ID NO: 87184 - DNA, 772 bp, Zea mays
  misc_feature: Ceres CLONE 1574116
  misc_feature: Encodes the peptide sequence at SEQ ID NO. 87185
ctggagctcaccgcggtggcggccgctctagaactagtggatcccccgggctgcaggaattcgtctcacccctagaaaaagagacacacctcggccgttcttatccccagaagcttccgatcgtctcccacacccgaccgcctgccaaacccgacacactcgtcgcgtcgcggagcttctctcctcgcctcttcatgcgccatcgccgccgcctccacctctgcgacgcccacagataggcaggaggaggagggggcgatgccttcgatctcctgccacaatctcctcgacctcgccgcggccgacgaggtgcctctgccgtcgcccacgccgctccgcctcccgcgcgtcatgtccgtcgcgtccccggcctcgcccacctcgccgcccgcgcccgccccgccgcgccgcgtcatcgtctcccaccgcctgccgctccgcgcgtcgccggacccggcggcgcccttcgggttcgccttctccgtcgacgccggcaccgtcgcttaccagcttcgctcggggctgcccgccaacgcgcccgtcctccacatcggcaccctcccagccgccgcggccgaagccgcctcagaggagctgtccgactacctgctagccaatttctcgtgcctgcccgtgtacctccccaccgacctccaccaccgcttctaccacggattctgcaagcactacctctggccgctcctccattacctcctcccgctgacgccgtcgtcgctcggcggcctgccgttccagcggacgctctaccact

SEQ ID NO: 87185 - protein, 171 aa, Zea mays
  misc_feature: Ceres CLONE 1574116
MPSISCHNLLDLAAADEVPLPSPTPLRLPRVMSVASPASPTSPPAPAPPRRVIVSHRLPLRASPDPAAPFGFAFSVDAGTVAYQLRSGLPANAPVLHIGTLPAAAAEAASEELSDYLLANFSCLPVYLPTDLHHRFYHGFCKHYLWPLLHYLLPLTPSSLGGLPFQRTLYH

SEQ ID NO: 87186 - DNA, 831 bp, Zea mays
  misc_feature: Ceres CLONE 1574119
ctccccgcggtggcggccgctctagaactagtggatcccccgggctgcaggaattcgtctcacccctagaaaaaacttgcctgccccccacttctccgatctccgccccatcggacttcccaagggtcggctaggtctaggtgtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacaagcagcgggagcaggagactctcgcctccgccgccctctccctcccgctcctccgcagccgccttctcccgctccgccggcaacgcgactgccggatgccctcgcgccgccgcccgcctcctttcgtctgcacggatcgccggcgccgccgccgccgcaattccacggcatcctcggggggctcggccacgccatcgcctctcaattcttcggccacggagctgccgcggtgacggacgggggcgccgggtgggtacaattcctcagggggttcaaccactgctgacgacgagtgacggcctcgagctagctcgtactgctcctacgacatgtacgctgtccgcatgctcgagcgcgagggcaccctgacggcgtccagctacagcctagaacgaggacggtggtgatctaggatgggaaaggtcgtggagggagctctcgtcggtaggagatcgcactgcttccttctggttgtgcaggggacatggccgtggaagcgcaataggcctctcaaaagagtggtcaaggtgactgaa

SEQ ID NO: 87187 - DNA, 899 bp, Zea mays
  misc_feature: Ceres CLONE 1574121
  misc_feature: Encodes the peptide sequence at SEQ ID NO. 87188
  misc_feature (899)..(899): n is a, c, t, g, unknown, or other
ggagctccccgcggtggcggccgctctagaactagtggatcccccgggctgcaggaattcgtctcaccccttaaaaaaaatattctcgtcggcgcatatggcatgtaggaggatgtccatgcccgagaggttcactctgaatgtgggggaggagacttcggccgtttccggcaggccgttcgcccggcccgtgtcccgaaccatctccatccaggatggcctcatggacctcccacacgacatctagtccgcttgggacttgttctgtgggactgtcaagaagtaccccacaaacaggatggtcgggcagcgtcgagattctgatggcaagggcggtgactatgtgtgtcctacgtacgacgaactgtggctgaaggtcatgaggattggatgatggattagaaccctcggcgtacagcctggagctgactgtgagcatatatggcatccaactgccccgattgggttatagtccttgggggcatgtaacactccagggatattgcaatgttgccactgaatgacctcctgggagctaaagctgttggattcggcgtggtaccatgctcacatagtccattgacttttggctggggagagcaagatcaaatccatactagctcgttctccctactctgccaggtgcatttttgaatacattggttggttttgggatatttttgggatgctaagattaaaacccggaaactatgagagaatgggggacctctccatggtttatgcttgggggaaggaatttttcctttccgtggggaaaaaatcaagaattttcccttctttggctaagttgaaacgggtaaaagggaagaatttttaatcgtcccaattgcattgttaaaaaccaacgcggtcaaacataaccttggaagaattcaccn

SEQ ID NO: 87188 - protein, 49 aa, Zea mays
  misc_feature: Ceres CLONE 1574121
MACRRMSMPERFTLNVGEETSAVSGRPFARPVSRTISIQDGLMDLPHDI

SEQ ID NO: 87189 - DNA, 817 bp, Zea mays
  misc_feature: Ceres CLONE 1574125
  misc_feature: Encodes the peptide sequence at SEQ ID NO. 87190
tggagctccccgcggtggcggccgctctagaactagtgggatcccccggagctgcagagaattcgtctcacccctagaaaaaacctctccttccctccacccgtgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaaggccccaagtacaaagaaattgtaaacatccgaacttggagatggcaccaatcgccgggggtcaaatccctgaaaagtgaatggccaaaaaaccttgttgggcagggtcttttaaagggaacttccgggaatggcccaacgaatttcccccaacccgtggccagttttccaggggcaaaggtttttggaaaaaaccccccgggcccccacctggaaattgggttgtggggccccctttttttaaaaggggttccggggaaaaaaccctttttggaaaattggggcgcccccccccatatattgggcccggaaaacccccacccgggggaaaatatccccgggggggaaaagtttctttttttacccccccggggggggaaagaaaaacccctccccccggaggggggagagagtgttccccccaaaagtgggggtgatatccccccccccccctggtgtgtttccgtgaaaaaaaaaatacacccgccggcg

SEQ ID NO: 87190 - protein, 45 aa, Zea mays
  misc_feature: Ceres CLONE 1574125
  misc_feature: SWISSPROT Homolog: EC 3.6.3.14 H(+)-transporting two-sector ATPase
MGLVKEGIDMEEGTLEIGMEYRTVSGVAGPLVILDKVKAPSTKKL

SEQ ID NO: 87191 - DNA, 814 bp, Zea mays
  misc_feature: Ceres CLONE 1574126
  misc_feature: Encodes the peptide sequence at SEQ ID NO. 87192
  misc_feature (770)..(770): n is a, c, t, g, unknown, or other
ctccccgcggtggcggccgctctagaactagtggatcccccgggctgcaggaattcgtctcacccctagaaaaagtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattgaaaatgcagaaggcgcgaggacgacaccctccattgttgccaagaatcagaatggtgacctgttgattggtatcacagcgagccggcaggcagtaaccaatgcccagaacacaatccgtgggtcaaagcgtcttatcggtaggacttttgatgacccacagacccagaaagagatgaagatggtgccttacaagattgtcaaggcgccgaatggtgatgcctgggtcgagatgggtggccagcagtactcccctagtcagattggtgcatttgttctcactaagatgaaagaaactgcagaagcttaccttggcagacagtctctaaggggctgtatactgtcccagcttattttaatgatgctcaacgccagctaccaagatgcntgtaggatgcttgactgaaattatgaggattatcatgagctacc

SEQ ID NO: 87192 - protein, 212 aa, Zea mays
  misc_feature: Ceres CLONE 1574126
MAFGALVTSRLARSGRTLASAVAQGPVAQRIAPPLLSRLGAVARLLSTKPAATDVIGIDLGTTNSCVSVMEGKTPRVIENAEGARTTPSIVAKNQNGDLLIGITASRQAVTNAQNTIRGSKRLIGRTFDDPQTQKEMKMVPYKIVKAPNGDAWVEMGGQQYSPSQIGAFVLTKMKETAEAYLGRQSLRGCILSQLILMMLNASYQDACRMLD

SEQ ID NO: 87193 - DNA, 813 bp, Zea mays
  misc_feature: Ceres CLONE 1574133
  misc_feature: Encodes the peptide sequence at SEQ ID NO. 87194
  misc_feature (813)..(813): n is a, c, t, g, unknown, or other
caccgcggtggcggccgctctagaactagtggatcccccgggctgcaggaattcgtctcacccctagaaaaaccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgtttacagttgccagagaggttgagctgggaggaccctgtggagaacatttggtgctaaattgggtcaggcaagcagcagctaagaccaatgatctagcttgggagatgggacaaaccacctctgtggtccctttgctcaggggctgaaccccttaagggtgttaagggttgtgggcagctggtgctaatccctgctcagattaactcgcggtatcgagaaaacagggaaaagccctagtttaaaaaactaccggaagttgtcttaaggaagccggaaaataagggagccttgcaaaattgtgctggcttttagtggcgggcaaacacttacaaaatggggaaaatggatagccgaaggccttgaaccaagggccgn

SEQ ID NO: 87194 - protein, 94 aa, Zea mays
  misc_feature: Ceres CLONE 1574133
MASTFGATSTVGLMAAPTGKNVRLQRRVNFRVRAAKELYFNKDGSAIKKLQTGVNKLADLVGVTLGPKGRNVVLESKYGSPKIVNDGVYSCQRG

SEQ ID NO: 87195 - DNA, 1172 bp, Zea mays
  misc_feature: Ceres CLONE 1574134
gggggggccgtgtgctctgtgcggctggcgcgcgagccccttaagagaaagcggtggcggttttgattaaaaaaactttttcttgagctccccgcggtggcggccgctctagactagtggatcccccgggctgcaggaattagtctcacccctagaaaaattcccgttccccaattcgaaatcgagtcgggtcggtcttgccgtgcgtgcgtggctgcgcgaaccagcccacgctcccactccccgcccgccaccggcgggtccctctagggttttgccgcgatggcgctccggccgaccgagcgggagcagatgcggaagggcaactactagcagaagggggacgccgaggagagccacccccgccgccaaggccagaacggcgacatccgcaaggccaagcgagagggaaagcctccagaaggaagcgcccggatggggttccccgcctatggggggccgggtcagccgaatggggcccactcccaatacatggcctggaagaagtttcggtatggctttgggctggcgaaatgttagcggggccgcgttcccccgcaaaacgcgatattcccctgggtggacggccttgggggggccaccccgcccggagtatgtgattgggaaagccgttgtgtgtttgggcgtagtgaacggggtgaattgctgtagcggagattttgaaaacaaaggggtgcgcatatccaggacaacaacacggaataatcacgcgtggaccgcctcgcacgagttttacgcgtcggtgatgagtttatctacggcctcacccacgccgggtgcgggggtgtgcgtcattctctctgcatcatctcacggtcaaagtggttgtttttatatggcaggtgtgtggacgggggggagtcgagggcatgcggagacgccgagagggtgttaggacagaccacaggcaggacacgcactctcgggcaagagcccgcctctttgttgtgtcggggacacgtggatagtggcggtgaggaggtgttcgttcgcttcttgcctcccatagctcgcggttaaagaggagaaggggtcgtgtgcaacggtgccgcgatgtaagggctacgttgggggattttgtctggggtgcttacacgcgggtgcgagatggtgtgggtttatgttgtggtcgcgcacggagagtggtgggg

SEQ ID NO: 87196 - DNA, 890 bp, Zea mays
  misc_feature: Ceres CLONE 1574137
  misc_feature: Encodes the peptide sequence at SEQ ID NO. 87197
aaagctggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaaaaagccggaacttgtctagcctctcaagtcccggccaggagccccaggtacatgggggttcgcctggctccaaatccccgcgtgggccccttccggtgaaccttggggcctgcaagcccgggggaaaggcctttacaggaccgcgaacattcgccctcctatgggtccccacccctacgaaaaaagaataaagttacgcccggggacaaaggggtccgcccattcgtatttacccgcctgtggtggctccgcctcaaagagggggaaggggtccatacctaggggcccatctggag

SEQ ID NO: 87197 - protein, 75 aa, Zea mays
  misc_feature: Ceres CLONE 1574137
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELV

SEQ ID NO: 87198 - DNA, 1222 bp, Zea mays
  misc_feature: Ceres CLONE 1574139
  misc_feature: Encodes the peptide sequence at SEQ ID NO. 87199
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (66)..(66): n is a, c, t, g, unknown, or other
  misc_feature (826)..(826): n is a, c, t, g, unknown, or other
atattgtgttnnanatataaataatatataggcaactctcagactttctgtttttttnnnngctcnttttttcaaactggagctccccgcggtggcggccgctctagaactagtggatcccccgggctgcaggaattcgtctcacccctagaaaaatgtagaccacactccactccagcactgaacacttgattgattcagtgggtagctagctagctgaatcacaatggatcctaccaagttccgtccgtccagtaaccacgacacgacggtgacgaccacgaacgctggcgctcctgtgtggaacgacaacgaggcgctgactgtggggcctcgcggtcccatcctgctgagagactaccacctgatcgagaaggtggcgcacttcgagcgcgaagcgcatcccggagcgcgtggtgcacgcgcgcaggacctgaagaaagggcttcttcaagagcaccaaccacttgacgtccccccacttacgacgaatttccctgcccccccccaggcgtgcccgaaaccccgtgaaaccgtgcgccttcccccgacgggggaacccacgagagcggggggtttcccccgggaaaaacaaattcccgcaaacacccgctgggggggtttttaagcccgtgggaaaattttctttccaacccccgaaaaaaagggggcgtaaaacctaggggaaacaccttgccctctgggggaggagaaaaaaaaaatttttcctccccccggatgttgtttttcttgttctacaaaacaccaggcgagatagagagagggtacatttctcccacaaaatgttttactcccccccctcttnaaaagcgggtgatatatccccgctcaccccagtgtttttattaatagatgagcccaccaaaaaagaaactcccggatggggggtgtccgccccaccccatttctctttcgaggaaggaaaatactcctgtggcggaggagtgtgggatgttatttgagataattttctcctcttgggtgaggagacccacttcctcccccaataaaaaaaccccgtgggggataccacacctacatgttgtttttacggccaactttcttcgaaagaaaaaagagggggggcggagtgtgccacccccccgcaaaaaaattattctcacaaacaacattaaagaagggtgtctcctccctctttaaataaaaacaaaaaacgccctttcttgtgataaccgagccg

SEQ ID NO: 87199 - protein, 133 aa, Zea mays
  misc_feature: Ceres CLONE 1574139
  misc_feature: SWISSPROT Homolog: EC 1.11.1.6 Catalase
MDPTKFRPSSNHDTTVTTTNAGAPVWNDNEALTVGPRGPILLRDYHLIEKVAHFEREAHPGARGARAQDLKKGLLQEHQPLDVPPLTTNFPAPPQACPKPRETVRLPPTGEPTRAGGFPREKQIPANTRWGGF

SEQ ID NO: 87200 - DNA, 1308 bp, Zea mays
  misc_feature: Ceres CLONE 1574140
  misc_feature: Encodes the peptide sequence at SEQ ID NO. 87201
  misc_feature (1)..(1): n is a, c, t, g, unknown, or other
  misc_feature (968)..(968): n is a, c, t, g, unknown, or other
nttttttgttttttgggttctggtggggggggatgagaacccccccaaggggtgggggaaggaaaaggattttgcaaaacggaactccccgcggtggcggccgctcttaaatagtggatcccccgggctgcatgaattcgtctcacccctagaaaaacactttccttcaggatccagcccgcaccaccgcacgtctcctcctctctcaacaccggccaccgtaacaggaataatccagctcgtgattgaagaatccgatgacgacgccatgcctgggcgccgcggccttaagcgccagctggacggcgcgctccctgacgggggcgtttctcgatctgacgctcgcctgggcctgcctctgcatcgccgcgctcgccgccgccgccgcgcgcctcctcgcgctcatcggcctcccgctcctatgcatctgtgcgcgcccgcacctgccctgcctactcgccttcctggcgcgctattctccccccgccgtcgtgattccttaacaccgacgcctcagagacagttttcataatatgacgggtatctacaaaagacgaatggacggccttgttttatagtggtgtgtgagggaaagtaagtttgaaattaggaatcggaccataggtctctcccgtaaccaaggccctgtcagccggcaatgggacgagtgaatgaggtgaaggggcgcctaatgtgtatctagttcgtaatatatatatttatctgacgagttggcatcttcattaaggatccgctccatatcatcaattattgactaaaatttaatggtatgtgatataatatgtagaatgagaaaaacatgcgatgtgtagaatacaggcagtatgtcgttagtaggatacgaaacgccatatacagaggtgcgcgcgcccgggagtaggcggagtgtataggtcgatagggcttacgtcttagtgtgtagtgcctgagaaacattgggtggtagnttatgtggtgctgacatataatgatcttctagattataagtgcaggtgatgggtaatgatatggggaatgccagggcacgagcacgcgaactgatagaccaaacaagaagcacgatcatttcaagtaatcggcgcgatgttatgtaggatataaaagtaatatacatatatcgtggcatgcacctcgcagtctcgtgaaatagatcgtgagtgagtattacgtgagttgagtgacacatcaaatggggcacaccgaggagtagagaatatagatcacgaagaaggcacacatatggtggacagtgttaatgtaggtagtcaaatatctggaaatagactg

SEQ ID NO: 87201 - protein, 81 aa, Zea mays
  misc_feature: Ceres CLONE 1574140
MTTPCLGAAALSASWTARSLTGAFLDLTLAWACLCIAALAAAAARLLALIGLPLLCICARPHLPCLLAFLARYSPPAVVIP

SEQ ID NO: 87202 - DNA, 827 bp, Zea mays
  misc_feature: Ceres CLONE 1574142
  misc_feature: Encodes the peptide sequence at SEQ ID NO. 87203
ctggagctccccgcggtggcggccgctctagaactagtggatcccccgggctgcaggaattcgtctcacccctagaaaaatcctccacgcgaatccgcatctccagactccaaccagcgctcgtccctccccgttctttcctcctcccttcagccatcgcagtcgcagcgcaggttcttggctggttgctggtgtcgacagcaaagtccgcaactccaatcctgcctgcgctcctcccgtcctcactcagcacccgcgcacgccgcctgcctgtcgattgagatctctttcacgcccctttctgccatcgcacaactgaggtacggttctttgcttattgcagagtatagtatggatgcccgcagtgagtcgtcgtgtcgtgccttcagtaggaggtacggtacttgtgctgtaggagcagttcataagtcgccacactgttttcaggaaatgacagtctttgtgtgtgtatttcatagatctagagcattcactgtcttgtccctttgcagccgcagctacgatactattaacatcaatttgtctggtcaataaatcactcggagcaatcgtgcgagtctttgtgtgtgtatttcattgatctcgagcactcactgttttgtgcctttgcagccgcagctagtaacatccattttgctggtcaataagtcgtgggaggaagaagatggattatttgaaggtgcaggtggtagagtcatcatttgtagtgccgagcgagccgacgccaacgaaggcgctctggctctcttgcttggacatgggtcagtccaacaaagcccacaccccaacgatccacttgtacagct

SEQ ID NO: 87203 - protein, 47 aa, Zea mays
  misc_feature: Ceres CLONE 1574142
MDYLKVQVVESSFVVPSEPTPTKALWLSCLDMGQSNKAHTPTIHLYS

SEQ ID NO: 87204 - DNA, 811 bp, Zea mays
  misc_feature: Ceres CLONE 1574148
  misc_feature: Encodes the peptide sequence at SEQ ID NO. 87205
ctggagctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcaccaacctccgcgtgctctcgctccgctccaaccgcgtcctcgggaccgtccccgacgacgtgctccagcttgccagcctcaaggcgctgtttctgcaacagaacctgctctccggccccatcccgacgggaatccagaagctcggcggcctcgagcgcctcgtgctctcccacaacaacctctcgggctccatccccttcgcgctcaacaagctcaccgcgctgcgagtgctcaagctcgacggcaac

SEQ ID NO: 87205 - protein, 177 aa, Zea mays
  misc_feature: Ceres CLONE 1574148
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGPSVPAAALAALLAVAALTCCAVAEPPPSERSALLAFLTATPHERRLGWNASTPACGWVGVTCDNANSTVVEVRLPGVGLVGAIPPGTLGRLTNLRVLSLRSNRVLGTVPDDVLQLASLKALFLQQNLLSGPIPTGIQKLGGLERLVLSHNNLSGSIPFALNKLTALRVLKLDGN

SEQ ID NO: 87206 - DNA, 867 bp, Zea mays
  misc_feature: Ceres CLONE 1574149
  misc_feature: Encodes the peptide sequence at SEQ ID NO. 87207
tggagctccccgcggtggcggccgctctagaactagtggatcccccgggctgcaggaattcgtctcacccctagaaaaaactcccactcttcaagcccacacagagctctgcacaagaaaaggggaggaaggacgagccggagccactcagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagcgggagcgtggtcggcctgagccttcgccggggttactgccgagaaggatcctggagattaagcgcatgggttccttggaggcccggtacaggccggccggggcagctgaggacacagctaagagaaggacccaaaaaagcaaaagtttcaaagaggttgaaaaatttgatgtttttgtgctggagaaaagttctggttgcaaagtccgatcgatgcaacttttgctcttcgctatcatgtctgctggatttttaacaatcctatacaccaccttctgtgtaatgagcatcagtttgcagtcaaagctctcgggcttgtcaatgggggggaaaggggataaaaaggagttccgaatcccccaaaaatgtatttttctggctaccatttaaaggggggggggagggtattttaaaaaagttccccaaaatcttggaagtgtggggggagaaaaaaaaaccccccggtggtggggacccccccgaaatttttttcaccggggacggggatgtttccgcaccctctgggaaaaacccaattgcgccc

SEQ ID NO: 87207 - protein, 107 aa, Zea mays
  misc_feature: Ceres CLONE 1574149
MGSLEARYRPAGAAEDTAKRRTQKSKSFKEVEKFDVFVLEKSSGCKVRSMQLLLFAIMSAGFLTILYTTFCVMSISLQSKLSGLSMGGKGDKKEFRIPQKCIFLATI

SEQ ID NO: 87208 - DNA, 850 bp, Zea mays
  misc_feature: Ceres CLONE 1574150
  misc_feature: Encodes the peptide sequence at SEQ ID NO. 87209
ctcaccgcggtggcggccgctctagaactagtggatcccccgggctgcaggaattcgtctcacccctagaaaaaacccgtagtgggatttggtgggagctgcgctgctcgcccctcgcgtttctttgctcaattgggggtcacggtcacggcccgcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctccgcagcagcagtacggaggcactccgctcagctcgccccccaagctcaacctgttccaccaaactcgcccccagttccaccacttcccgccgccgcatgtcggcggcctgccaatccctggagaaactgatgccgatgggccatctagaccaattcctcgccgaacccaggcttctccctagcgcccggcgcgggctgtcccggcttctaaaggccgcccccgggtggaagtggcttatgggagggcttcgggcgttccccgggaacattttggggaattcccggaaagccggggccccattcgggggccattttaagggaaacttgagagctccggggaaacggccccggggaaaaaaaataccccgggggttcccgaataccccg

SEQ ID NO: 87209 - protein, 123 aa, Zea mays
  misc_feature: Ceres CLONE 1574150
MNCGPPDQLPPGSAPSCFLNLNWDQSMAADQLDPALSSMVSSPASNSTAAAAVTDGRALHGISPQQQYGGTPLSSPPKLNLFHQTRPQFHHFPPPHVGGLPIPGETDADGPSRPIPRRTQASP

SEQ ID NO: 87210 - DNA, 1101 bp, Zea mays
  misc_feature: Ceres CLONE 1574154
  misc_feature: Encodes the peptide sequence at SEQ ID NO. 87211
  misc_feature (58)..(58): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (75)..(75): n is a, c, t, g, unknown, or other
tttgggaaggcaaacaccgcaccttctattaataagaatggttttggtattataaaanaaaaananntgtgggtnggtggaaactgggagctcccgcggtggcggccgctctagaactagtggatcccccgggctgcaggaattcgtctcacccctagaaaaaaaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggacgagaaccgaaaggtgtagtagccttttccggtagggcatctgctatagccggccggttgaagcaggggagcgagaggaggagggcagccgagcaggagcatctcagtggtggttaagcagcagcaacgacgacgacgacgacgctgacacccttccccgttcccgacggcacgtccaccgaggcggcgccatcacgatgggtgcctctggcgccgctagaggtgtaaccgcgccgccggccgttctccaaagtcgccggggggtccctgactgcctgcttgtccaaagtccgctcaccccttcttactgcgtgagcccgaagcccccccctccctcggaatccgggcttgcatagggggcggccggtgggaccctccctcacgggagggtgaaggggcggccccccgcggggtagggaccataatgtggcaaccgcggtggcccttgggagccgcaacaccttgtcccggggaaaaaataacttgcagattcctccgggaaaaggtgaccttgccttcccagggagttgcgaaaccccgcattggggaagtatccttgtccgtggtattggggtcgacagggcctccaaacccacgccacgggtttctcggatggtacacccccgccggcctccccgaggggaaacgggtagttcctggggggaccggccccaaagccttatcgcgagggagaaaagtacgggggggcggcgggaccctatggccacatttggcctttgagagccaccctccataagttgtggaa

SEQ ID NO: 87211 - protein, 37 aa, Zea mays
  misc_feature: Ceres CLONE 1574154
  misc_feature (20)..(20): Xaa is any aa, unknown, or other
  misc_feature (22)..(22): Xaa is any aa, unknown, or other
  misc_feature (23)..(23): Xaa is any aa, unknown, or other
FGKANTAPSINKNGFGIIKXKXXWVGGNWELPRWRPL

SEQ ID NO: 87212 - DNA, 798 bp, Zea mays
  misc_feature: Ceres CLONE 1574160
  misc_feature: Encodes the peptide sequence at SEQ ID NO. 87213
  misc_feature (621)..(621): n is a, c, t, g, unknown, or other
ctggagctccccgcggtggcggccgctctagaactagtggatcccccgggctgcaggaattcgtctcacccctagaaaaactcctttgggcttgtctctgcctctctctctcctcccttctcccacccacccctctctcttgctgtgggtgtgctgtggagaggagaaaggaagtagagcaagaacaagaactaataacaccaacaagagctgctgccaactcctgcacagcctgggctctcatcactgattgcccacctattaccttcctcttttgcgatttagaatcacccatatatctacctgctctcggtcctctgtgaactctctcgtcttctaggtttcccaggcctcaagataggcctctggaccaaagcttgaaagcagctgctgttcttgcctctttttttaattcttcatttcgtggttcctggatttttgggttcttaggtttcttgtatcttcccccaaccttgcaaaatcttgtggtgaagtttcttgcgttcgctgtttcgggaccatggacgataggattccgccgccgtccctcttgcaatactcgcagtcccctgctcattcttccccccatcccctcatttctatgaggtattcttcctctgnaagagaaagtgagtgttgttctggaattttttttatttcttttggcactaatgttccccccgttgttcctgggggagttttgttttgttttgaatccggccctttcggaacccttctgaagaccacagatttaatgccgcgggggaaatttccgccttaattcaaacttccggaaac

SEQ ID NO: 87213 - protein, 86 aa, Zea mays
  misc_feature: Ceres CLONE 1574160
  misc_feature (34)..(34): Xaa is any aa, unknown, or other
MDDRIPPPSLLQYSQSPAHSSPHPLISMRYSSSXRESECCSGIFFISFGTNVPPVVPGGVLFCFESGPFGTLLKTTDLMPRGKFPP

SEQ ID NO: 87214 - DNA, 893 bp, Zea mays
  misc_feature: Ceres CLONE 1574161
  misc_feature: SWISSPROT Homolog: EC 2.7.9.1 Pyruvate, phosphate dikinase
ctcaccgcggtggcggccgctctagaactagtggatcccccgggctgcaggaattcgtctcacccctagaaaaagagagaataagctgtatggcgagtatctggtgaacgttcaaggtgaggatgtggttgccggaataagaaccccagaggaccttgacgccatgaagaaccttatgccacacgcctacgactagcttgttgagaactgccatatcctggacagcccactacaacggacaactgcggatgtcaagttcacttgtccagtagaccaggctgtcggatgcttggagtgcaaggaaagggcaaacttccgggacaaaattggccattgaaagacccccttggacctgttaaaccagggccttgtttgaccgccgccccagccatccaaaatggtaggaagcccgtccccccctggaacccaccttcttccttttcctccaggttggggaaacccccgtggggcggtcccaggggatcaaaattttctttggccccttttggtttgggggggggttttccccccctgggggccttctctttttccgcaaaatttttttttggggccccccccctggctttaagagagaaggtgtttaaaaaaaacacccgggtggtttccccccccggggggagaaaaaaaccttctttttttcttctggggggaggagggggggaaaaaaaaacacctccccccctccttccaaaagaaaaaaaatttaggggggggcgcaacaacaccccccccactggggggggggggtttttctcctacaaaaaaaggggggggggggagagaaaaatctcccctccccccttttggtttttttttcttccccaccctgttttgggggtgggaaaataacacaaccaccccctgcggggggg

SEQ ID NO: 87215 - DNA, 829 bp, Zea mays
  misc_feature: Ceres CLONE 1574163
  misc_feature: Encodes the peptide sequence at SEQ ID NO. 87216
  misc_feature (597)..(597): n is a, c, t, g, unknown, or other
  misc_feature (613)..(613): n is a, c, t, g, unknown, or other
agctccccgcggtggcggccgctctagaactagtggatcccccgggctgcaggaattcgtctcacccctagaaaaaaaaaaaattcgcagtagcagataaggcgcgttgcgttatctaatccgtccaagaggctgcggtgctcgctcaggctcactgctcagtgctcactgctcactagctaaaaacatctcctttcttatccatggagacggcagcgctcacctcccactccctgcagcgcccagcagcagcagcagctgctcccgcgcatggccagcggcggagggtcggagcggcgggcctgcggcaccggcagccgcgcgccggcggcaggatccgggccctgccttcggcggaggtcatcagcgagatcctgagccccaagctggtgcccggctcgcccgccgacaccggcgacgtctcctcgctcgtcccggtcagtgccctgatgctgctcttctacttcgtgtccaactgggtggtgcccgagctgctcctgaaaggcctcaaggagcccaagccccgagacgaagcgtccacgtcctttcgcgcgtccgcgggacacgccgccgccgctggcccagcagacgacggcngcgcccgtaagatccngcctcaagtcaagaagaagaagaacgggaaaccgaccatcgccaagtcctaggtaggtaacaagggaacccacccctttggggccgtgcaagggggtcccccaccctcttgaataagtttttacccagtccccctccaaaactccaaagggaaaaaccctcctcttcctgttttcctgccccggggaaatctttttgaatccccctaaaaacacta

SEQ ID NO: 87216 - protein, 153 aa, Zea mays
  misc_feature: Ceres CLONE 1574163
  misc_feature (132)..(132): Xaa is any aa, unknown, or other
  misc_feature (137)..(137): Xaa is any aa, unknown, or other
METAALTSHSLQRPAAAAAAPAHGQRRRVGAAGLRHRQPRAGGRIRALPSAEVISEILSPKLVPGSPADTGDVSSLVPVSALMLLFYFVSNWVVPELLLKGLKEPKPRDEASTSFRASAGHAAAAGPADDGXARKIXPQVKKKKNGKPTIAKS

SEQ ID NO: 87217 - DNA, 1188 bp, Zea mays
  misc_feature: Ceres CLONE 1574169
  misc_feature: Encodes the peptide sequence at SEQ ID NO. 87218
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (70)..(70): n is a, c, t, g, unknown, or other
  misc_feature (74)..(74): n is a, c, t, g, unknown, or other
  misc_feature (936)..(936): n is a, c, t, g, unknown, or other
  misc_feature (1036)..(1036): n is a, c, t, g, unknown, or other
ttggttgtgggggatgggggcttagtatcgcgcccaatttactgtgcgggggagnnnnnnnnnttattnnttanaaagctggagctccccgcggtggcggccgctctagaactagtggatcccccgggctgcaggaattcgtctcacccctagaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccacccgtcacctccacgagcccgaccaaacaatcagggtcatcccacaaggtcggggaggcgtccgtgcaccaactccaggagggcatgcgcgccctgcttcgatgccccccagaacatggatgggcgattcctggctccaaagcggggggaagaagatcctttaggggaaaattggggcaactccaccggagaaatcaaaagcctcccttctcccttttggatgaggggcttatgggggtgccccctatggaaaagagggggggaaaaaaaattttttttttccttggagaagggggaaccacggataataaaaggtcttctctagggagaaaatttttacctccgcgacacagagcgccgctgctaacacaactaacgccctccggaagggggcggggggtttaaaagaaaataaccgcgcggccccaaacatcgtgaatatgaaccaggggggggggggacgcaccacccttcctctgtgtggcaaaatgccgccgagcgatgttggggagacgataggcggggcgcgcgtcaagacgcgcgcctccattttacgtgaaaatgggcctagaggggtgccgacgatgagtccgttagggtcaaaaaaaaaaatctnaccctcctctctcgtggaaaaatatagttattcggggcggaggagctttatctttagataaagctatacctagacttcttttttaataatatttcgcccnccagcgcgaaaaagggggctcgtcggagcacacgccggatcgaggataataacaaacattgcgctcggcgaagtatgtagcgcggtttatatgcgcgtcttttgggctgaaaaaagaaatgcgtgtaccgcccgctccgtgtgaatgaacgg

SEQ ID NO: 87218 - protein, 89 aa, Zea mays
  misc_feature: Ceres CLONE 1574169
  misc_feature: SWISSPROT Homolog: EC 1.2.1.3 Aldehyde dehydrogenase (NAD(+))
MGAFAKEEHQFLAELGLAQRNPGAFACGAWGGSGPTRHLHEPDQTIRVIPQGRGGVRAPTPGGHARPASMPPRTWMGDSWLQSGGKKIL

SEQ ID NO: 87219 - DNA, 1247 bp, Zea mays
  misc_feature: Ceres CLONE 1574173
  misc_feature: Encodes the peptide sequence at SEQ ID NO. 87220
  misc_feature (57)..(57): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
ggggagtggcggtgatggcgcctctccttctagccggtcctcaccatctccggtccncccccccctnnnnnnaaaagctgggactcaccgcggtggcggccgctctagactagtggatcccccgggctgcaggattcgtctcacccctagaaaaaactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctggcttgccggcgggtgccatggcccaagaggtgctgctgggcgcaggcgacggcgggttcgtcttcgagcccagccagttcaccgttcagggccggcgaacacccatcacattcaagaaccaacccccggcttccccgcacaaacttcgtctttcgacaaaaacgaagggcccaagccggcgtcgaccccccccccaaaaatcctcggcgggaagggaagtaacttcaaacgcgcccaggggcgagacccttttcttccggtacccccttcaccccggggccggggaaaaccctaacgggctttccgaactggcctagacccgcattccaagggaagtccccgaaaatgggtcccggacaagagagcccccccggtctaaacttaaaatttgagggccctgggccttattccggaattcgcggactacccccgatttctcaatcggcgacctccaagcccctgggcgtgtgtctcttcccccggtggctcgttgttgcaaaaactcttcctcctcccccgagaaacgcgattcagggctcatgtatctgccgcacaaccgtgtgggggtcggcttgccgatcgaaagtcgaacgcgacatatgaacatggtcggcgttttggtgcggatggcgcagagctttgacggcatatcataatagtggtgccaggggggcctctcgcgctggacgatcggaaattagataacttcttcgtaagacaaaacaaagacgtccgctccgctatcccctccgcacatagcggggggagcgcgcccccttttgcctgggcgcgactctccccctccgagggggggtcggcactaaatcaacgaggcgcccggtggctccagaagtggccaaatgtatccccccttgccgcgcctttgacataggtggaaccaaacgccccaggtatcttgtcgcg

SEQ ID NO: 87220 - protein, 124 aa, Zea mays
  misc_feature: Ceres CLONE 1574173
MASLSSAAVTAPSFAAPAPARAVVRRRSFTVRASLRKATGTAAVAMAASALACRRVPWPKRCCWAQATAGSSSSPASSPFRAGEHPSHSRTNPRLPRTNFVFRQKRRAQAGVDPPPKNPRREGK

SEQ ID NO: 87221 - DNA, 1036 bp, Zea mays
  misc_feature: Ceres CLONE 1574174
  misc_feature: Encodes the peptide sequence at SEQ ID NO. 87222
  misc_feature (14)..(14): n is a, c, t, g, unknown, or other
  misc_feature (44)..(44): n is a, c, t, g, unknown, or other
  misc_feature (58)..(58): n is a, c, t, g, unknown, or other
  misc_feature (59)..(59): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
aacaaaagaacaanagaaaaaaaaaaaaaaaaaaaaaaagaaanaaaactgatacttnnaaggaaaaannnacaaactggaactccccgcggtggcggccgctctagaactagtggatcccccgggctgcaggaattcgtctcacccctagaaaaaaccaccaagacgacgacaacgacgacggggacgaggagggccgcagcctcaagccgccaccaatgcccacctcctccactaaccccagcactgagttcctctacctcggaaccctcgccaccccgccgccgccggggccgcagcaccccgggacaagttccagtctacgccctggctcgccggagctccgccctctgcctccgcttccgcgcgtcggcccgccgtccggcgagttcttatcccgcagctccgcctccgaccccagcaccgtgcctcccgccgccgctgccgatgcctcgtcgtcctcgctctctccgccctccccatcagcatcctcgcccacgctcggctccagccccgtccatttccgcccgccgaccatcccccagccggcgtggccgaacccccaatcccctcgccgccctaaacggaagggcgtcggccgccccaagggtgcttgccggagcccagtgggcggggcgcacggggtgggaaacccctttctttgcccgcctgcccgccggcgagaccaagctggggggccttccatctcaggaaggaatgggtggaaactcctggaattcaggatggaatgggaaccctggtcccacaagtttcgacggggcctttttggccaccctccggaaacaagagcttcaaaagccccggggcttccttttgggccagttaaggaacccaaaacttcctttcagagggtttccccctcccttcctttcattccgagaaaaccaaaattcgcaatttccctggaagggttggccctcctgcgcccctaatggtgaccttaatgggccttgtaaaggaaccagagggtggatatcccccctttttccctttcaacaaattttccggccgcccg

SEQ ID NO: 87222 - protein, 244 aa, Zea mays
  misc_feature: Ceres CLONE 1574174
MPTSSTNPSTEFLYLGTLATPPPPGPQHPGTSSSLRPGSPELRPLPPLPRVGPPSGEFLSRSSASDPSTVPPAAAADASSSSLSPPSPSASSPTLGSSPVHFRPPTIPQPAWPNPQSPRRPKRKGVGRPKGACRSPVGGAHGVGNPFLCPPARRRDQAGGPSISGRNGWKLLEFRMEWEPWSHKFRRGLFGHPPETRASKAPGLPFGPVKEPKTSFQRVSPSLPFIPRKPKFAISLEGLALLRP

SEQ ID NO: 87223 - DNA, 785 bp, Zea mays
  misc_feature: Ceres CLONE 1574176
  misc_feature: Encodes the peptide sequence at SEQ ID NO. 87224
ggagctcaccgcggtggcggccgctctagaactagtggatcccccgggctgcaggaattcgtctcacccctagaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcggtgatcggcctgctcctcgccaacccgcgggtccaggtcgtgcccagggccaccttcaagctcctgagcaagctcgtcttcgcgctcttcctcccctgcctcatcttcgtccacctcggcaagtcggtcaccatagacaacgtcctgcactggtggttcatccccgtcaacgtgctcatcagcactgccatcgggtgcccccttgggtacatcgtgggccctgatctggcgcccggcgcccgcacctgtttccggttttacgggtgatcatgaaccggggttccggtaaacccgggggaaac

SEQ ID NO: 87224 - protein, 117 aa, Zea mays
  misc_feature: Ceres CLONE 1574176
MVWSMDPQVTVHGDWVSAVVPLMKLLCLAVIGLLLANPRVQVVPRATFKLLSKLVFALFLPCLIFVHLGKSVTIDNVLHWWFIPVNVLISTAIGCPLGYIVGPDLAPGARTCFRFYG

SEQ ID NO: 87225 - DNA, 805 bp, Zea mays
  misc_feature: Ceres CLONE 1574177
  misc_feature: Encodes the peptide sequence at SEQ ID NO. 87226
  misc_feature (643)..(643): n is a, c, t, g, unknown, or other
tggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgccatcgtgctggtgtgcggcgccgagctgggcagcctcacccgcgacgagctgtggcgcaaggtgggggggggagggcaactaacgacctccccacgtgctcggcttcctcggcgttctcccccttaacaatctccgtcaaaattatggccaggcccagggcccgtggtaccttattgaactttcccatggtaaaaacccgggcgaagaaacttcaaggggggccaagggggggaattttatccnaccctggggggcccaaatttcccgggcgaaatttttcaaacaaaaaaaaaaaccctggagggttttcccaaaacccgcggttttttggtggtggccacaaaattccggggggaattgtgggggaaacaaaagatatttttatatagtggggcggggcggggg

SEQ ID NO: 87226 - protein, 110 aa, Zea mays
  misc_feature: Ceres CLONE 1574177
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPAIVLVCGAELGSLTRDELWRKVGGGGQLTTSPRARLPRRSPP

SEQ ID NO: 87227 - DNA, 1071 bp, Zea mays
  misc_feature: Ceres CLONE 1574180
  misc_feature: Encodes the peptide sequence at SEQ ID NO. 87228
  misc_feature (834)..(834): n is a, c, t, g, unknown, or other
  misc_feature (936)..(936): n is a, c, t, g, unknown, or other
  misc_feature (1071)..(1071): n is a, c, t, g, unknown, or other
tttttttttttttttttttagggggctatgggggggcgagagtatggaagggtagagctatgtgggaattggggggagctggagctccccgcggtggcggccgctctagaactagtggatcccccgggctgcaggaattcgtctcacccctagaaaaagcccccctccttccacgtccccaccctgccgtcgtcgctactcgcatagagattcgcgcggccgtgtcttgctcgcgcctgcccccttccttccttgtcgtgccagcgcccagatctctcgctcgccggcgctcgggccagatctgggtgggggctcggaggcggagccgggcgcaggtttggtttgacccaaggggcgaggaggagagggaagaagaccccggacgccatggagctggcggttggcggcgggatgcggcggtcggcgtcgcacacctcgctgtcggagtcggatgactttgagctcacgcggctgctcaccacaccgcggatcaacgtcgagcgccagcgctccttcgacgaccactctctcagcgacgtctcgcactccgggcggatacgggcagggggtggcttcgacaggaatgtaactcgccctgggggggcggccatgcggctcctctcgatccggcaagaccgggacctccctcccggcgcctgggaacatcctttcataagcccccaaccccttattcgttacggggcgaaacgaccctgggggaaagggcggcataccagcacgggcataccccttccggatctttacctctttcgggggggtcagagacaccccttttgggacaccccgttttgccccggccgagtccgaacctancgccgtttccagaaagggaaagatccccttcataactgccagaacacaaagtgggtttggggggatggggaattgttcggttggccggaagggcaaatgagngggagttgtttggagacaaatgcgggaaggcccaagaaaatttggtacaaaaaaaactttcctctttcgcaagggacccctgccttgtatgacagggccttgggaaaaaaaaaaaaattctgatcgcggatatan

SEQ ID NO: 87228 - protein, 223 aa, Zea mays
  misc_feature: Ceres CLONE 1574180
  misc_feature (149)..(149): Xaa is any aa, unknown, or other
  misc_feature (183)..(183): Xaa is any aa, unknown, or other
MELAVGGGMRRSASHTSLSESDDFELTRLLTTPRINVERQRSFDDHSLSDVSHSGRIRAGGGFDRNVTRPGGAAMRLLSIRQDRDLPPGAWEHPFISPQPLIRYGAKRPWGKGRHTSTGIPLPDLYLFRGGQRHPFWDTPFCPGRVRTXRRFQKGKDPLHNCQNTKWVWGDGELFGWPEGQMXGSCLETNAGRPKKIWYKKNFPLSQGTPALYDRALGKKKKF

SEQ ID NO: 87229 - DNA, 1084 bp, Zea mays
  misc_feature: Ceres CLONE 1574181
  misc_feature: Encodes the peptide sequence at SEQ ID NO. 87230
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
nggttttggtgccnnnnnnntnctggggaggacaaaaataaaaaaaagtagaaagaaaaatattaannnaaannnnnnccaaaactggagctccccgcggtggcggccgctctagaatagtggatcccccgggctgcaggaattcgtctcacccctagaaaaaacaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgatcgcgatccccttctccctgctgctcctgccgctcctgctccgctacctcgcggcgtcagcgtcggcgtcggccccccccacaaagaactactgagcggcggcggtggcggccagcgaccccgacaagctcttgagcctgctgccgtcgccgcccatgaaacctcccccatcatcggggcacctgcaccctgaatggggggaacatccccctaacgtgtgccctcggccggcggttcggcccaccaagggtaccgggcccgggaaaccttgaaatgcttggctcccggcccttcggggcgcccgttgtcccgaacaccggagggatgggctcccccgatgccgccccgcccggcggttccggcccccaaaagggacccgttggctctcccggcaaccccctaaacgaaaccccacggttcttttttctttccttccccggacacccgggggatatccccctggggggggtccccgaaaaattcccttctgtggttagccggaggggcccacacccaaaatcctcttggccatttgtgcggccccccatacagggggaacccacacttttcccgcacaagggggcccgaagaaaaacctcggggtaaaccacggtggaacccctgtgcttaaaaaagccccaagaaaaagggttcccgggtgcgcaccaacaggcccc

SEQ ID NO: 87230 - protein, 38 aa, Zea mays
  misc_feature: Ceres CLONE 1574181
MKPPPSSGHLHPEWGEHPPNVCPRPAVRPTKGTGPGKP

SEQ ID NO: 87231 - DNA, 831 bp, Zea mays
  misc_feature: Ceres CLONE 1574182
  misc_feature: Encodes the peptide sequence at SEQ ID NO. 87232
  misc_feature (704)..(704): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (713)..(713): n is a, c, t, g, unknown, or other
  misc_feature (777)..(777): n is a, c, t, g, unknown, or other
  misc_feature (781)..(781): n is a, c, t, g, unknown, or other
  misc_feature (790)..(790): n is a, c, t, g, unknown, or other
ctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccacccatatgattattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgttggttgatccgattgcgtctgctgtaccatatattaattggtccacgatgatatgatttgataccatatatatatatatatactaaaaaccggactttctttttttaaaanannanaaantaaaaatattttatattaaaaaatataaaaaaaataaatataaaaaaataaataattttaaaanaaantaaattaantttccccgggctccccccttaaaaacccccccccgccccgg

SEQ ID NO: 87232 - protein, 76 aa, Zea mays; identical to SEQ ID NO: 42649
  misc_feature: Ceres CLONE 1574182
  misc_feature (1)..(76): Pfam Name: Metallothio_2 Pfam Description: Metallothionein

SEQ ID NO: 87233 - DNA, 828 bp, Zea mays
  misc_feature: Ceres CLONE 1574187
  misc_feature: Encodes the peptide sequence at SEQ ID NO. 87234
  misc_feature (763)..(763): n is a, c, t, g, unknown, or other
  misc_feature (770)..(770): n is a, c, t, g, unknown, or other
  misc_feature (771)..(771): n is a, c, t, g, unknown, or other
  misc_feature (785)..(785): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaaatccgcgaaggttttcagtttgattatgtctttgactggacaatattgaagtaccaacaagctcaaattgccactgctccaccccgtgcgggccatggcgctgggccttctgggttggcacctgcattacagaatgataggcaaccaggccctgaggaagcaaggactagtggttggtcatcaatggatcggcgtcgtgccccactaccaattacaagtgtggggacattatctaagcagaaagcaccggtagggaatgatgctattgtttctagagacgctgtgatatctggaccaaatttcttgggaaggtcaagtggatcttcaaggaggcctgttatctcgagtagccgcgatgcggtggtcaccgatagttccgagccttcacgagcgcgcacaactgatgcaagccctggggtgttccgcagagcctcaggtcctcagagaagctcacctgtccactctgcagaacagaagcgctcatcctcaggccgtcatccatctaatgcgaagaactacgattccgctctcaaaggcattgaaggccttactttagatggcgacgagagggttcagtactagagcggcaagaagaaattctacatcccctgtaaaaaagcataaccaggtggtaaccattgtgtttccctgttgagttttggatcaacaggaaacagaatgantggaagnngagatctggtcacngtgttgtggcggttttcgggtggcccttctgagcaaggtaaan

SEQ ID NO: 87234 - protein, 219 aa, Zea mays
  misc_feature: Ceres CLONE 1574187
  misc_feature: SWISSPROT Homolog: EC 2.7.11.1 Non-specific serine/threonine protein kinase
GAPRGGGRSRTSGSPGLQEFVSPLEKIREGFQFDYVFDWTILKYQQAQIATAPPRAGHGAGPSGLAPALQNDRQPGPEEARTSGWSSMDRRRAPLPITSVGTLSKQKAPVGNDAIVSRDAVISGPNFLGRSSGSSRRPVISSSRDAVVTDSSEPSRARTTDASPGVFRRASGPQRSSPVHSAEQKRSSSGRHPSNAKNYDSALKGIEGLTLDGDERVQY

SEQ ID NO: 87235 - DNA, 832 bp, Zea mays
  misc_feature: Ceres CLONE 1574189
  misc_feature: Encodes the peptide sequence at SEQ ID NO. 87236
  misc_feature (787)..(787): n is a, c, t, g, unknown, or other
ctggagctccccgcggtggcggccgctctagaactagtggatcccccgggctgcaggaattcgtctcacccctagaaaaagcatctctcccatcacagtgcgccacccgcacccaccaacgaggcaacgaaacccagtcggaagctagaccggcgacaagtgcagcgctcgccgcgatggattctgactacggcgtgccgcgcgagctgtcggaggtgcagaagaagcgcgcgctctaccagcccgaggtgcccccctgcctccaggggactactgtcagggtggagtatggtgacgccgcaattgcagctgaccaggcaggcgctcatgtgatcagccatgcgttccctcacacctatgggcagccccttgcacatttcctcaggaagacggctgttgtccttgatgctaaggtcatatctgaacacccggtggtcagggttggcattgtcttctgtggcaggcaatccccaggaggccacaatgttgtttggggactctatgaggctatcaaggcccacaaccaaaacagcaaactcattggtttcctcggtggatcagatggtttgctagcgcagagaacattggagatcactaatgaagttcttgcttcatataaaaatcaaggtggatatgacatgcttggtcggacaaaggatcagattaggacgacagagcaggtcaatggtgcaatggctagttgccaggctttgaagttggatgctctggttataattggaggtgtcacttccaacactgacgctgctcaacttgctgagacttttgnctgagcaaagtgtgcaacgaaagttgtaggtgttcctgtaacttt

SEQ ID NO: 87236 - protein, 203 aa, Zea mays
  misc_feature: Ceres CLONE 1574189
  misc_feature: SWISSPROT Homolog: EC 2.7.1.90 Diphosphate--fructose-6-phosphate 1-phosphotransferase
MDSDYGVPRELSEVQKKRALYQPEVPPCLQGTTVRVEYGDAAIAADQAGAHVISHAFPHTYGQPLAHFLRKTAVVLDAKVISEHPVVRVGIVFCGRQSPGGHNVVWGLYEAIKAHNQNSKLIGFLGGSDGLLAQRTLEITNEVLASYKNQGGYDMLGRTKDQIRTTEQVNGAMASCQALKLDALVIIGGVTSNTDAAQLAETF

SEQ ID NO: 87237 - DNA, 822 bp, Zea mays
  misc_feature: Ceres CLONE 1574192
  misc_feature: Encodes the peptide sequence at SEQ ID NO. 87238
  misc_feature (747)..(747): n is a, c, t, g, unknown, or other
  misc_feature (762)..(762): n is a, c, t, g, unknown, or other
  misc_feature (772)..(772): n is a, c, t, g, unknown, or other
ctggagctccccgcggtggcggccgctctagaactagtggatcccccgggctgcaggaattcgtctcacccctagaaaaagtgtgcggagcaggtagcacacaagggagagggagacagagggaggagggagagaggaatcttcctgtttccttgcctgggactgggactccgtctccgtctccgtctccatccccatcccctgccgttgcgcccatctcatccccgcgtcttttcctctcgactctcctctctctctctctctctctctctctctctctctgcgctgctctcggtttaggtcgaggagttgctagctagctagggggtttggatccctgctggtgctggctgctccgctgctgcgtgctagtcctactccagccccccagccccagcgaagcaggcaagcatagatagaggctggggtgggcagggaggtgcgcggacggagatccatcagatcagaatcagatcacatcatcggccctcggatgcgatgcagcaccggcgcaagcccgcttccgccgcggcgccgccggccgccaagcagccggccgcgcgcaggcccacggcgcggctgtcgctcgcgggcctcgtcgtctccatcttcctcgtcgccaccttcctgtacaacgaggacgtggtgaaggcggcctccggctcctccagctcagcaacaacagccgacgccgctgaggtaggcgtctccgggcgggcgaagtcacccgacctaagggtgctgcangaggcggcgcaccanggggtggaanctgaagagcgggaaggtgggaaatcttacgggagcggagcagaagcagaa

SEQ ID NO: 87238 - protein, 108 aa, Zea mays
  misc_feature: Ceres CLONE 1574192
  misc_feature (83)..(83): Xaa is any aa, unknown, or other
  misc_feature (88)..(88): Xaa is any aa, unknown, or other
  misc_feature (92)..(92): Xaa is any aa, unknown, or other
MQHRRKPASAAAPPAAKQPAARRPTARLSLAGLVVSIFLVATFLYNEDVVKAASGSSSSATTADAAEVGVSGRAKSPDLRVLXEAAHXGVEXEEREGGKSYGSGAEAE

SEQ ID NO: 87239 - DNA, 825 bp, Zea mays
  misc_feature: Ceres CLONE 1574193
  misc_feature (825)..(825): n is a, c, t, g, unknown, or other
aagctggagctccccgcggtggcggccgctctagaactagtggatcccccgggctgcaggaattcgtctcacccctagaaaaagtgtgcggagcatgtgacacgaacgagagagggagacagacggaggagggagagaggaatcttcctgtttccttgcctgggagggagactacggcttcgtgggcgtctccttacacatggactgcagttgcaccaatctcttccccacgtcattgtacgcacgactctcctctctatgactctctctctctctctctatctctgctctggactctgctggcgtacgaagagttgcccgctctctgagggggtattggatcactgcatgggatgtgtgctggtatgctgcgtgctatatgtacaccacccgatgatccgcaggcaaccggccaacatagatagacgctggcctgcgtatggaagtgctccgacgagatctcctacgatgtgatgcaaatcagctctgcggtcctcaaacgcgaagcgcaaccgggtcccgcgctggtgatccgcggagccaactgtcctcaatgaatcgggcccacgcaggctcgcagtgcctatgtctatcgctggcctcactgtcaccatcttcatgtgcggcacctgcctgtctaactatgacatggtgcaaagatgcctcttgctcctccagctgcacagcaacatccgaagctgctgacgccaagctgctccgggcgcggagaagactgacagcactggtggcgctgcacgtacgcggacccctcaggcggaggaagcatcggatcagagtgggtatcaaattgtacggcatgcgaan

SEQ ID NO: 87240 - DNA, 792 bp, Zea mays
  misc_feature: Ceres CLONE 1574195
  misc_feature: Encodes the peptide sequence at SEQ ID NO. 87241
  misc_feature (453)..(453): n is a, c, t, g, unknown, or other
tggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaggtngtggggggaagccacctacgtacctcgcaccgtgctcgccttcctcgccgtcctcggccttcaccatcttccgtctaaaatcatggtccaggcccaagggccccgtgtacctcaatcaactttgcaatggcacaaagccggccgaaaaactccaaggggggccaagggcggagatttcttcaacctggggcccgcaaatcccgggaaaatttcaaaaaagaaaaaccctgggggttttcaaatcccgtcttgggggggcaaaatccgggatctgggggaaaaaaaatttttaatttccccccccccttctgtgtttttaaaccccaaaagcacagttgg

SEQ ID NO: 87241 - protein, 202 aa, Zea mays
  misc_feature: Ceres CLONE 1574195
  misc_feature: SWISSPROT Homolog: EC 2.3.1.119 Icosanoyl-CoA synthase
  misc_feature (90)..(90): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRRXWGEATYVPRTVLAFLAVLGLHHLPSKIMVQAQGPRVPQSTLQWHKAGRKTPRGAKGGDFFNLGPANPGKISKKKNPGGFQIPSWGGKIRDLGEKKFLISPPPSVFLNPKSTV

SEQ ID NO: 87242 - DNA, 825 bp, Zea mays
  misc_feature: Ceres CLONE 1574198
  misc_feature: Translation starting site: 206
  misc_feature (734)..(734): n is a, c, t, g, unknown, or other
  misc_feature (782)..(782): n is a, c, t, g, unknown, or other
  misc_feature (815)..(815): n is a, c, t, g, unknown, or other
  misc_feature (822)..(822): n is a, c, t, g, unknown, or other
ctggagctcaccgcggtggcggccgctctagaactagtggatcccccgggctgcaggaattcgtctcacccctagaaaaaacactcacctcagcctcacctgccttcccaatcaatcgcattctccgtccgcgacccaatccaggtgccgacagaccagataccagagcaaacaagaagccgtctcactccacgtcgcaagggaaatggccaccgcctcgctcgcactgctcgatcagacgctgctgccgtcccctctggcgtacaacggcggctccgaccgcctcagccaggagatcttctccatcctcgagtccaacttcctattcggcgcgtcgccgctggagggcggcgcgtgctccgcgggccgcgtccgcgtgctgtccatcgacgggggtgccgacggcggcgcgctggccgccgcagcgctggtacggctcgagcgccgcctgcaggagctctccggcaaccccgccgcgcgcgtcgcggacttcttcgacctggcggccggctccggcgcgggcgggttcctcgcggcggcgttgttcgcgtgccggatgcccgccgaggcggcgcgcgacgtcgtggccaagaaccggaaggtcctgtccgggcgtggcgggggcctgatgtcgttccggcgccccgaggccgcgttccggaaggtgttcggtgacctgacggtgcgcgacgccgccaagccgctgctgatcccgtgctacgacatggccaccngcggcgccgttcgtgttctcccgcgccgatgccgtggaggccgacgcngtcgacttcccgctgtggcaggtgtgcgcggcngcttgcngcg

SEQ ID NO: 87243 - DNA, 794 bp, Zea mays
  misc_feature: Ceres CLONE 1574200
  misc_feature: Encodes the peptide sequence at SEQ ID NO. 87244
ctccccgcggtggcggccgctctagaactagtggatcccccgggctgcaggaattcgtctcacccctagaaaaataaaaaggggaagcgagaccgccgccacatgcctcctggcctcctacctcgcggctgcctcctcctcgtcgttccccatcttcgccgccacttgccggcgctttgttctactcttcgaagcagccactcgcataagcgccccgcggttatcttctcccccgtacgtgccgtctccggctactccgccatggcggctggttcgccggagcagcagcagcggagcgttgtggtcaaggagactgtggagctcacggagacggaggagcgcatctttcgccgccttctcgaggttgttcgccacttcagtctcggcacgcagctccgcgtcgccggcggatgggtccgtgataagctattagggaaagactccgctgacattgacattgcccttgacaatatgacgggtcagaatttctgtgagaaagtaaatgagtactcaaagttgataggggagcagcagaaaggaatcggtgttatccaatgtaaccccgatcaatccaagcacttggaaactgctaggatgcttattcttgacatctggattgattttgttaacttgcggtctgaaacatatactgaaaacagccgtatccctacaatggagattggtactgccaaggaggacgcataccgcagggacttgacaattaatagcttgttctttaatatcaacaataactcggttgaagatttaactggaagaagtattgaggatctcaa

SEQ ID NO: 87244 - protein, 177 aa, Zea mays
  misc_feature: Ceres CLONE 1574200
  misc_feature (45)..(175): Pfam Name: PolyA_pol Pfam Description: Poly A polymerase head domain
  misc_feature: SWISSPROT Homolog: EC 2.7.7.25 tRNA adenylyltransferase
MAAGSPEQQQRSVVVKETVELTETEERIFRRLLEVVRHFSLGTQLRVAGGWVRDKLLGKDSADIDIALDNMTGQNFCEKVNEYSKLIGEQQKGIGVIQCNPDQSKHLETARMLILDIWIDFVNLRSETYTENSRIPTMEIGTAKEDAYRRDLTINSLFFNINNNSVEDLTGRSIEDL

SEQ ID NO: 87245 - DNA, 775 bp, Zea mays
  misc_feature: Ceres CLONE 1574201
  misc_feature: Encodes the peptide sequence at SEQ ID NO. 87246
aaagctggagctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaagccctctggttcaaagccgggctcccagatccttcaccgaagggcgggctgggactaaccttgggcaaccccagcctgattccacgcccaaaagaatcctcccccattttgggccccgcccgggtccgggcccattggggccccccccaaaggggctccccttttttttcccggggggggccccctcccggaaagggtctctaaaacccccctgtttaacccccgggggggggaggttttttaaacccccccccggggg

SEQ ID NO: 87246 - protein, 191 aa, Zea mays
  misc_feature: Ceres CLONE 1574201
  misc_feature (61)..(158): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEALWFKAGLPDPSPKGGLGLTLGNPSLIPRPKESSPILGPARVRAHWGPPQRGSPFFSRGGPPPGKGL

SEQ ID NO: 87247 - DNA, 817 bp, Zea mays
  misc_feature: Ceres CLONE 1574204
  misc_feature: Encodes the peptide sequence at SEQ ID NO. 87248
tggagctccccgcggtggcggccgctctagaactagtggatcccccgggctgcaggaattcgtctcacccctagaaaaagactctgagataggaggtgggattgcagagtcacgcgtcagttcgttccctcctctgtgtaccggccagtaaaatccgaacccacagcgagaaatggcggcggcagcgctccgtccggcgatcctccgccgcatccgcctctccccctccccttcggctcgccctcgccgccgctgggacaggtgcatcccacccgcacgcgctggggcggtggctcgcgcgggccattgtctcccacgacgcgcaccttaacccgcgaagaagtcatcgaaccggattctcgacgttcatccaaaagcccccccagaaccaccccctctaagttgaccccggagggccacttccaaaaaaggactggggggcccaacagcctggaaacccgccaaaggggggcccggggccttccagggaggaagttccaagcccccaaatcccccgaaaattggggggggggaaaaaaaaaaccaatccccccccccttgggggctctcaagaataagcgcgccaaaaacccccccaagggggggggggggaaaaacctcttgtttttcccccccaaaaaaagaggggaaaggtttagacggggggggcggccccccccccccgggggtttttggtgttttgacgagaaggggggaaaaatatatcttctcgggggggagggggccaaaaaaaaaaataaaatttgtttttctgggggccgcggtccgctaatttttattatctctaggagagaag

SEQ ID NO: 87248 - protein, 49 aa, Zea mays
  misc_feature: Ceres CLONE 1574204
GAPRGGGRSRTSGSPGLQEFVSPLEKDSEIGGGIAESRVSSFPPLCTGQ

SEQ ID NO: 87249 - DNA, 832 bp, Zea mays
  misc_feature: Ceres CLONE 1574205
  misc_feature: Encodes the peptide sequence at SEQ ID NO. 87250
ggagctccccgcggtggcggccgctctagaactagtggatcccccgggctgcaggaattcgtctcacccctagaaaaactcctcccttcgtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccaactgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaaggtggcaggggtcgtcttcggcgacaacaatgctcagcaagcggtgcagttccctccggccgccgccgctgtcgcggtggtccctccgaaacgaggcgcccggccgtcgtacccaagaactgtggggggctccctgcggcggcccgaggacgaaacaactgggcggtgaaccccccgtggaccttgatggaccccctggggggcttccttccaagaaaaaaaggaacggtgggccccgcctccttgggattcaacattggatggggaaccggcaccc

SEQ ID NO: 87250 - protein, 103 aa, Zea mays
  misc_feature: Ceres CLONE 1574205
MSALLDLLMGIFRQQTLGGAALELAALAAPLWLAALVGLLIGWAWRPKVAGVVFGDNNAQQAVQFPPAAAAVAVVPPKRGARPSYPRTVGGSLRRPEDETTGR

SEQ ID NO: 87251 - DNA, 1062 bp, Zea mays
  misc_feature: Ceres CLONE 1574206
  misc_feature: Encodes the peptide sequence at SEQ ID NO. 87252
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ggtgggcggtgctcccgtttcccattcaccccccccgaagccagacccccacaccgaatnnnnannttnnnnnncaaactggagctcccgcggtggcggccgctctagactagtggatcccccgggctgcaggtaattcgtctcacccctagaaaaatctgaattcccagcacactcctgcccgctcctccccgccgatggagatccccaccgctgtcatccaccgcctccagtccgctctccgtgaggccaccttcgccccttctgtagaagatgcacccgcccctcccttcccctccgtcgccgatgccgtcgcagccttcgactcgtgtgccgcctccgtgtcggcggagctccgatgcgtgcgctgcggggcctcgggagggctcctgcgcggtgtgcggtctgccctctgcacctactgcgggtgccccaggcgcggggaggaggctgaaggcggtggaatcggcaccccccccttccgtgacggcgtggcctaccagtggctgctcgggtcgcttgggactcgacggaatcccagattgtagaaattcgatactcgacactaacaggcttcggaaataaaaagcaatggaatgttaccacccacccaaaacagttgggggatgaatccaatatcctggaatcgaacttgggaccctttaaaaaaatcaaccattggccccttcccgctggaaaaaaattaaagagggaaagaaccattcctctcccaaaaggtgttcccccctcaagccacaagggggaaggccaaattccaattccttttcctgaggggggaaatacccaccttaaaaaatttttatgtctcgggccgcgcctcaaccctttgaggaattgcacgttttttttccaattgtgtccagcgaaaatgagataggaagattggactttcctgggcctttcatcgtttcccccaaaaaacttcaattttttttttggggagcgcaggggataaatttcaaaggcaccccgaataccgctaaaaagccccccgtcaattcccaagaattggggaaaggcgcaatggcctggcaacccaat

SEQ ID NO: 87252 - protein, 116 aa, Zea mays
  misc_feature: Ceres CLONE 1574206
MEIPTAVIHRLQSALREATFAPSVEDAPAPPFPSVADAVAAFDSCAASVSAELRCVRCGASGGLLRGVRSALCTYCGCPRRGEEAEGGGIGTPPFRDGVAYQWLLGSLGTRRNPRL

SEQ ID NO: 87253 - DNA, 1077 bp, Zea mays
  misc_feature: Ceres CLONE 1574209
  misc_feature: Encodes the peptide sequence at SEQ ID NO. 87254
  misc_feature (900)..(900): n is a, c, t, g, unknown, or other
gtggagaggggaagagacagtttttccttttttccgttttgcggattcaccggtcgctacaccggccacggcttttcaaagctggtactccccgcggtggcggccgctctataatagtggatcccccgggctgcatgaattcgtctcacccctagaaaaaaactgcgatcgagcaagggacaatggcccgcaccgcggcgccggccgcgggctacggagaggacggagtgtaccgctccccgcgcccggccgtgcgcatcgagtccgacacaggcctctccctcaacgacctcctcttccgccgcgccgacgtgtgcccctccgctctcgcgctggtcgactccgccaccggccaatccctcaccttcgccgcctttcgctccgccgtcctcaccacagccgtcgccctctcctcgcgcgcgggcgtcctgcgcggcgacgtagtcctcttcttcgcccccaactgcttcctctaccccgtctgcttcttcaccgtcaccgccctcggcgccgtcgctaccacggccaaccccctctacacccctcgggaggtcgctaaacaggccaccgacttcgcgtgccaagctcgcaatcaccggtctcttgaactcccttccccaaatcctgggaccctcgggcttccccacccatccctgcttcgaacggccagacaagcatacaagacgaacgccgggacaatagacacacaccgcccccccaaaggcaccccaagagggtagacccaagtccgtatggaacacaccttttatacctacgatgaacccttcactttctctcccaggaaggcaccccgtgggaagtaccacggaagttaacccgcgtcctttcccacgaccaccaaacgttaaatccataaacccgctaccatccttaccactntgtcccagtatcaaccaacccccgattcccgagtacaccgacactgggggggccataacccaataacgggctactcaaatccactagaaacacacaccggagaaacccagtcaatactaccatggcgggcccgccccctctgatttgcaacaggtcccgaacccatctcaacccccg

SEQ ID NO: 87254 - protein, 185 aa, Zea mays
  misc_feature: Ceres CLONE 1574209
  misc_feature: SWISSPROT Homolog: EC 6.2.1.12 4-coumarate--CoA ligase
MARTAAPAAGYGEDGVYRSPRPAVRIESDTGLSLNDLLFRRADVCPSALALVDSATGQSLTFAAFRSAVLTTAVALSSRAGVLRGDVVLFFAPNCFLYPVCFFTVTALGAVATTANPLYTPREVAKQATDFACQARNHRSLELPSPNPGTLGLPHPSLLRTARQAYKTNAGTIDTHRPPKGTPRG

SEQ ID NO: 87255 - DNA, 1224 bp, Zea mays
  misc_feature: Ceres CLONE 1574211
  misc_feature: Encodes the peptide sequence at SEQ ID NO. 87256
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (40)..(40): n is a, c, t, g, unknown, or other
  misc_feature (45)..(45): n is a, c, t, g, unknown, or other
  misc_feature (57)..(57): n is a, c, t, g, unknown, or other
  misc_feature (66)..(66): n is a, c, t, g, unknown, or other
  misc_feature (67)..(67): n is a, c, t, g, unknown, or other
  misc_feature (74)..(74): n is a, c, t, g, unknown, or other
  misc_feature (75)..(75): n is a, c, t, g, unknown, or other
  misc_feature (456)..(456): n is a, c, t, g, unknown, or other
  misc_feature (458)..(458): n is a, c, t, g, unknown, or other
  misc_feature (519)..(519): n is a, c, t, g, unknown, or other
  misc_feature (592)..(592): n is a, c, t, g, unknown, or other
  misc_feature (873)..(873): n is a, c, t, g, unknown, or other
  misc_feature (894)..(894): n is a, c, t, g, unknown, or other
  misc_feature (913)..(913): n is a, c, t, g, unknown, or other
  misc_feature (962)..(962): n is a, c, t, g, unknown, or other
  misc_feature (1001)..(1001): n is a, c, t, g, unknown, or other
  misc_feature (1092)..(1092): n is a, c, t, g, unknown, or other
  misc_feature (1096)..(1096): n is a, c, t, g, unknown, or other
ccagcccggtcnnnntttnttaaaagttttttcacccacnccatnaaaaaaggaaanaatataaannagttttnntcctattggggagctcccccccgagggtggccgctctctctagaactggatgcaccccctggctagaagaattcgtctcatccctagaaaaatccgtgaaggttttcagtttgattatgtctttgagtggacaatagtgaatttccaacaagctcaaattgccactgctccaccccgtgcgggccatggcgctgggccttctgggttggcacctgcattacaaaatgataggcaaccattccctgaggaagcaaggactagtggttggccatcaatggatcagcgtcgtgccccactaccaagtacaagagtggggacattatctaggcagaaagcacctgtacggaatgatgctattgttgctaaagagcgctggggggncnaggaccaaatttcctagggaagggataagaaacacctctctaggagcgcctgtacatctcncaacaagccacaaatacaagagatccaccggataggtttccaaggcctgtcactgagatgcagcacaaactanatttcaaggctccatggtgggtgtttccggtatgaggcccttcaccggtcccttcagaaggaaatcgtcaacccatgttcccacttcctggcaagaagatcaatataacccgccttcgtgttcctcaggtgcctacggtcaatcccccattcctttaatttgtcggcaaagcataccctagtcgtgagtgaactctggccttctctgccagaagagagggcctcacttcgctaaatgggaggcctctttctcaccctttctcttgtgagatggggttcaantatcatttaacccaatgcggnatattcctatgtgttactncttatgtacttccgccgctcccagcgtagtggataaatatttccattanctatgtccctcccctgcggcttaaatacaaacaccttantatttccctcgagttagggtttgagtatataattaacgcacgtgttctcaccactgagcgcaaggtaaaaatttttataaatttcgtttcntggntaaacaaccgctaattgtacctgagagtttttgggaagtatagacttgggatgcactcaaattgttttctttccgcggagattacagaaggatgggtcccccttctcacgagaccgataggactataa

SEQ ID NO: 87256 - protein, 116 aa, Zea mays
  misc_feature: Ceres CLONE 1574211
  misc_feature: SWISSPROT Homolog: EC 2.7.11.1 Non-specific serine/threonine protein kinase
  misc_feature (111)..(111): Xaa is any aa, unknown, or other
  misc_feature (112)..(112): Xaa is any aa, unknown, or other
MHPLARRIRLIPRKIREGFQFDYVFEWTIVNFQQAQIATAPPRAGHGAGPSGLAPALQNDRQPFPEEARTSGWPSMDQRRAPLPSTRVGTLSRQKAPVRNDAIVAKERWGXXDQIS

SEQ ID NO: 87257 - DNA, 854 bp, Zea mays
  misc_feature: Ceres CLONE 1574213
ggagctccccgcggtggcggccgctctagaactagtggatcccccgggctgcaggaattcgtctcacccctagaaaaaagttccagagccctccagagcaaaaaaaatatattatcgaatactaaagcattttcctcatggatagaatatagaattttaaaaagggagcgaaataggtttttcctttttgcagctccgtcgtccaccaacctcctccgatccggccgccgcagcgtagccgaattgtgtcctcgctagcttctccggccggctagaggctgtttaaggcggcctcgatctcctccgcgcggctgaggaaggagatcacgcggttgctcaggggctggggcgtgcatgatgggattttggttgattccgatggagactccggcgacgccccacccaagtaagagcttcttgcgccacaagatcgccgccatgctcgcctcctcctactgcttgttatagatcccaccccctcgacgtcgtcgtcggcacggcagctagctcgctagcttctgtacataggtcgacgcgccatatagacactagtctcggattaagcgataattaaggcaaagaatctcccagtttgcttcgttcttgcattgaaccatggagtctggacggctcatctttcacgcgcccgaggtctggcgccggggcagatgcttcttccttcaactgcgggcgcaagcaagctgtccccagcggccggtttggtccaatcgaaggccgggagaccgattgcttgggcctttggaagaaaggccccgggcggtaaaaaggggcctttttttaaccttctgacccaaacaaagctcctaccaaggaaaaaaattactttcgaacga

SEQ ID NO: 87258 - DNA, 906 bp, Zea mays
  misc_feature: Ceres CLONE 1574214
  misc_feature: Encodes the peptide sequence at SEQ ID NO. 87259
  misc_feature (906)..(906): n is a, c, t, g, unknown, or other
ctccccgcggtggcggccgctctagaactagtggatcccccgggctgcaggaattcgtctcacccctagaaaaaaaaaaggtcgggaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtcgcgctcgcgctcgctaccgtgtcgtacctctggtccacgcccggcgtcgcgccggggttcttcgacatgttcgtcctcgccttcgccgaaaccctcttccgcccttccttccgcaaggatgaacttggtatttggggaagaaagcttgggggagggcgccattcccggggtcgttgggtaaaggcctcacctgggcgaaacccccgaaaagcgccgaaaaaagccaaggggggtatttgggtccgtggaaaaaagggcaatcagaagtaatggtggcaggtgggagaatttcggaatgaaacggaaaccggtccagggaaggggcatggctccttagtagccctggtgccggaatttttaatattatatgggctttttggcgaagaaccaaaaagcaaaaagaggaaaagggtaaccctaaaaaaaaaatttgggcctttattttgtgggggattttttaaaaggggaaggaaaaacccacctttttatggattcctccctggccaagagggcgagagggaatatcccccctttaccan

SEQ ID NO: 87259 - protein, 179 aa, Zea mays
  misc_feature: Ceres CLONE 1574214
  misc_feature: SWISSPROT Homolog: EC 2.7.11.1 Non-specific serine/threonine protein kinase
MAASGLGLSTSFLPGHDTLLRRRRRRPAGHAAASFRPVTAELGGVATELGRQLVEAVGVGLPCTVMQCGDVIYRSTLPRNDGLTITAPGVALALATVSYLWSTPGVAPGFFDMFVLAFAETLFRPSFRKDELGIWGRKLGGGRHSRGRWVKASPGRNPRKAPKKAKGGIWVRGKKGNQK

SEQ ID NO: 87260 - DNA, 901 bp, Zea mays
  misc_feature: Ceres CLONE 1574216
tccccgcggtggcggccgctctagaactagtggatcccccgggctgcaggaattcgtctcacccctagaaaaagtgtgcggagcaggtagcccaccagggagacggagacatagggaggagggagagaggaatcttcctgtttccttgcctgggactgggactccgtctccgtctccgtctccatccccatcccctgccgttgctcccatctcatccccgcgtcttttcctctcgactctcctctctctctctctctctctctctctctctctctgcgctgctctcggtttgggtccatgagttgctagctagttacggggtttggatcactgctggagctggttgctccgctgctgcgtgctgtgtcggactccagaccaagaggtttttcccccccccccaagcttctatagaggctgcgctgggcagagaagtgcgcggacggggatccgtcgtagttgactcgcatcaccttctcggacctcatactcgatgtagcatcgagcttagtccacttcctgctcagcgcacgccgggctcctagtacacgggccccgcgcaggccctaggccccctctaggcgctccggggcccggacagctccccatacttccttcgtgggccacctttcccggtaaaaacataggaccctgatggtaaggcgtgccctccccgcctttctaccagttttctgaaaacatggcttccggaaagcccccctttgggtgtcggatgttcctccggcggtcgaggcccaaaggcccccccccggacccttaagggggggcgcgacaccgcaacggggtgagccgaatccccgggtggcccccgggaaacgccctctttttctccccgtgtaaaagcctgtgtgaacaatacgctgataaggcgatctttcgc

SEQ ID NO: 87261 - DNA, 791 bp, Zea mays
  misc_feature: Ceres CLONE 1574218
  misc_feature: Encodes the peptide sequence at SEQ ID NO. 87262
ctggagctccccgcggtggcggccgctctagaactagtggatcccccgggctgcaggaattcgtctcacccctagaaaaagacgcgacgaattatctttatcccctttccctctaccgtcctcgttcccggccgtccgtgccgaaggaagtatctgctgacccagcccatccacctcgctccctcgaccgacccacccagcccagcgcgagctcgcatggcgatgctgctccgcaaggtgtggggctccgtgctggcgcgcgccgcagcgccgggggccgacccgcgggcccgccgcgcgcaggcgcatcgcgcggagcagtaccagtaccacggctcgctatcgctgggcgcgctcgacgccgtccccaccgacgtgctcgcccagatcctgcgcctgctgggcccgctcgacgccgcgcgctccagcgccgtctgccgcgcctggcgcgtcctcgcctccgacaacggcctctgggctttcttcctccgcctcggccccgagccctgggacctcgtcgtcttcgccgagacgcacctcgccgccggccccgcctcgcacccgtggctgtactacgatagctcgccgcagctctcgttcaaacagatttacggcctccgagcgctggtcccgggtactctcatcgtggatggtggatctggttattgcaagtatggctggagcaagtatgctgctccttccgggcgttgtgctacattcttggaattcggtaacattgaagcacctatgtatgcaggcttcgtcactctctctacatatatacagatgaa

SEQ ID NO: 87262 - protein, 191 aa, Zea mays
  misc_feature: Ceres CLONE 1574218
  misc_feature (45)..(92): Pfam Name: F-box Pfam Description: F-box domain
MAMLLRKVWGSVLARAAAPGADPRARRAQAHRAEQYQYHGSLSLGALDAVPTDVLAQILRLLGPLDAARSSAVCRAWRVLASDNGLWAFFLRLGPEPWDLVVFAETHLAAGPASHPWLYYDSSPQLSFKQIYGLRALVPGTLIVDGGSGYCKYGWSKYAAPSGRCATFLEFGNIEAPMYAGFVTLSTYIQM

SEQ ID NO: 87263 - DNA, 840 bp, Zea mays
  misc_feature: Ceres CLONE 1574221
  misc_feature: Encodes the peptide sequence at SEQ ID NO. 87264
  misc_feature (840)..(840): n is a, c, t, g, unknown, or other
ctccccgcggtggcggccgctctagaactagtggatcccccgggctgcaggaattcgtctcacccctagaaaaaacagttccaaagatccctccaggaaagatttttattccctcctcacgacgccccatcctacctacacactctatattgcagccccccagtaacacgcatgaacgctgaatcgcaagcagaggaaagaaaactccgaaagccagtctgcgcgagttggatggacttcttcttggacctcgtgtgcatcctcatcttgctatccttcacctcctacatccattacactctctggcagaaggggaaaggccgcttccgcggccatgggaggtctgctcccttgaagctgcctccaggctccatgggctgaccttaccttggcgagaccctccatctttactcccatgaccccggcgtcgtcttcgcttacaaacaggaagatgtaccgcgagatcttcaagacgcaccttctgggctgcccgtgcgtaatgctggcgagccctgaagctgcgcggttcgtgctggtgacaaaagcgctcctgtgtcagtcgacctacccgcggagcaatgagcgattgataagaccggcagctctcttcttccaccagagggactgacacctccgcctgcgaaaggtcgtcctgggcgcgctcaggccccgatgctctgcgcgcgctcgttccctgaaatgataggccgcccgtgcgtccttgtctctgcttcctgggaacgccagttcaagttctgaaagcagcgctccaggcccaatgaaagaagcttgatagttttgaccttggggcaataagttgacccattcctttgggaaggn

SEQ ID NO: 87264 - protein, 70 aa, Zea mays
  misc_feature: Ceres CLONE 1574221
  misc_feature: SWISSPROT Homolog: EC 1.14.13.93 (+)-abscisic acid 8'-hydroxylase
MTPASSSLTNRKMYREIFKTHLLGCPCVMLASPEAARFVLVTKALLCQSTYPRSNERLIRPAALFFHQRD

SEQ ID NO: 87265 - DNA, 801 bp, Zea mays
  misc_feature: Ceres CLONE 1574222
  misc_feature: Encodes the peptide sequence at SEQ ID NO. 87266
  misc_feature (597)..(597): n is a, c, t, g, unknown, or other
  misc_feature (626)..(626): n is a, c, t, g, unknown, or other
  misc_feature (629)..(629): n is a, c, t, g, unknown, or other
  misc_feature (631)..(631): n is a, c, t, g, unknown, or other
  misc_feature (632)..(632): n is a, c, t, g, unknown, or other
  misc_feature (700)..(700): n is a, c, t, g, unknown, or other
ctccccgcggtggcggccgctctagaactagtggatcccccgggctgcaggaattcgtctcacccctagaaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcngctctcttcttcaccagggggaactacanctncnngctcgcaagctcgtccagggcgcgctcggccccgacgcgctgcgcgcgctcgttcctgaggtggaggnccgccgtgcggtccaatctcgcctcctgggacgccgccacgtcaagagcacgtttcacgcccttaaaaaccccttccctttgaactggggcatcctggaca

SEQ ID NO: 87266 - protein, 184 aa, Zea mays
  misc_feature: Ceres CLONE 1574222
  misc_feature: SWISSPROT Homolog: EC 1.14.13.93 (+)-abscisic acid 8'-hydroxylase
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (158)..(158): Xaa is any aa, unknown, or other
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFFTRGNYXXXLASSSRARSAPTRCARSFLRWRXAVRSNLASWDAATSRARFTPLKTPSL

SEQ ID NO: 87267 - DNA, 1050 bp, Zea mays
  misc_feature: Ceres CLONE 1574225
  misc_feature: Encodes the peptide sequence at SEQ ID NO. 87268
  misc_feature (54)..(54): n is a, c, t, g, unknown, or other
  misc_feature (56)..(56): n is a, c, t, g, unknown, or other
  misc_feature (69)..(69): n is a, c, t, g, unknown, or other
  misc_feature (784)..(784): n is a, c, t, g, unknown, or other
  misc_feature (809)..(809): n is a, c, t, g, unknown, or other
  misc_feature (810)..(810): n is a, c, t, g, unknown, or other
  misc_feature (944)..(944): n is a, c, t, g, unknown, or other
  misc_feature (968)..(968): n is a, c, t, g, unknown, or other
  misc_feature (995)..(995): n is a, c, t, g, unknown, or other
  misc_feature (1050)..(1050): n is a, c, t, g, unknown, or other
acgaacaccacacttttttttttttcaaaagagagggggggtaaacaaaaaatntnataggggtgtttnaaaaactggactccccgcggtggcggccgctctagaactagtggatcccccgggctgcaggaattcgtctcacccctagaaaaagatcagcagcagcaactctctccctctccgttcttggtggtccgagacccttggccgtacgctctgcctcactcctccgtctcttgcttcccttgccgccggcggcgcgcggcgccgggcgcggatcggcggcgggcgcatggtggaggccgccgccgggcgccggacaggcaccagccctcggcggcctagcggcagcggaggggagcaccggcacctggtcgcgctcgccgtcgccgcgcgcgtcgccatggtcaccacccggtccgtgggtccagcaagtttttgcggaaggtgatggagcgggagctgctgtaacccccccccggcaccgctggcggtggcggaatatgcataggagaacttcttcgacttgcctcctcgggcttgctcctggacccttaaggcattgacatggggcttggcggccgcgagaccccaagcgggcaaactcgccggcccggacagaaatgcccttcatcctagggactttaccaggggcgcatgggggtcccttggcgtgcccataacttgtaactttgcccccgagaccggttattatcgaaccaagagagggagaagcactcacataagggagcccaaacccccacccgggagcccacggtaattngcgccccaatgaccaaaaatggggnngtccccatggaaggacccacggtcgggcgagtctcctcccttagtaactacgcccgctgtgaaatagtggcctaagcctaagggggctccgctcccaaaccaaaaggatatgggcccctaccaaactatttccncagagagaagacgaaaacccgggngtgtttccctaatgaacagtttcctantcccgcacgcccgattcttgggaagaggtggactccctacccatagacactctcn

SEQ ID NO: 87268 - protein, 52 aa, Zea mays
  misc_feature: Ceres CLONE 1574225
MVEAAAGRRTGTSPRRPSGSGGEHRHLVALAVAARVAMVTTRSVGPASFCGR

SEQ ID NO: 87269 - DNA, 856 bp, Zea mays
  misc_feature: Ceres CLONE 1574228
  misc_feature: Encodes the peptide sequence at SEQ ID NO. 87270
  misc_feature (856)..(856): n is a, c, t, g, unknown, or other
ggccgctctagaactagtggatcccccgggctgcaggaattcgtctcacccctagaaaaaatctccattggtgctgccattgtgaacgaaagggaccaggctatacgccccctctcctccaatccaatctccacaggacctgtgctgagctttggagcagctagtaattaagcctagagcgctagcagtccttttggatttcggttcggaagcaaggcgtgccggactcccaaatcccaatcccaagcaagcagtgtgcagatggcaacgcagtggttctccaacatggtgatggacgagccgagctttttccaccagtggcagtccgacacgctgctggagcaatacacggagcagcagatcgcggtggcgttcggccaccgcgagccggtggaccacgccgtggcggcggccctggcgacggcgatgccccatgcagctgcagcagcccgcggcggccgagcagccgcacccaccgccccgcgcaaggcggggccaagggtccaacacccgctggggacctccgggccatcacgggaagcagggccttcccccggccgggggaatccttcctcgcccaacaattccttttcctttcgggggggcacaaccgggtttcgcccaagggcccgaagccaaaaaaagccccccacccgcccaagggggttggccccggggtaaataagggggccccgccccccgccccccaaagggcgccccaaaccaggtaaattatatgggcccccccccccgcaattccccccccttttccaagaagggggcgcccccggggcccaagaggttcccataacaaaaaaatgtgggccccccgggggggccccagaagcgccctccn

SEQ ID NO: 87270 - protein, 139 aa, Zea mays
  misc_feature: Ceres CLONE 1574228
MATQWFSNMVMDEPSFFHQWQSDTLLEQYTEQQIAVAFGHREPVDHAVAAALATAMPHAAAAARGGRAAAPTAPRKAGPRVQHPLGTSGPSREAGPSPGRGNPSSPNNSFSFRGGTTGFRPRARSQKKPPTRPRGLAPG

SEQ ID NO: 87271 - DNA, 896 bp, Zea mays
  misc_feature: Ceres CLONE 1574232
  misc_feature: Encodes the peptide sequence at SEQ ID NO. 87272
aaagctggagctccccgcggtggcggccgctctttcacagatggatgccccgggctgcagtaaccaatatcagccctagaaaaagcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgagctccgcgccagcaccgccgacctggcgtcccccgccggcagggggtcggcgtcggcgggcgtgtcgcagggcgccaggcgcgcgacgatggagcacgtgatgacggtgctttcggcggccatcaccaaccagtacacctgcctcgaaggcttcccgtaccaaaagcggggggccgcgtggcggcgcctacatcctagccggaccttccaccaacgtggtcccgccatgggtgaggcaactcccctgggccatgggccatagaaagttggcccgggagccgggggtccattcatttggtgggccaagcgaaccgccggcggggcaagccgggtttactggggggtaaaggggcgcaaaataggttggaaatggggggttccccccccggggtggggagtggtggttaccagggtgggg

SEQ ID NO: 87272 - protein, 206 aa, Zea mays
  misc_feature: Ceres CLONE 1574232
  misc_feature (34)..(196): Pfam Name: PMEI Pfam Description: Plant invertase/pectin methylesterase inhibitor
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLSARDRLAINDCLELLSTTMDELRASTADLASPAGRGSASAGVSQGARRATMEHVMTVLSAAITNQYTCLEGFPYQKRGAAWRRLHPSRTFHQRGPAMGEATPLGHGP

SEQ ID NO: 87273 - DNA, 1131 bp, Zea mays
  misc_feature: Ceres CLONE 1574233
  misc_feature (49)..(49): n is a, c, t, g, unknown, or other
  misc_feature (1090)..(1090): n is a, c, t, g, unknown, or other
gtgggggggtgtggtggggggggttttcaccgaaatcatctcttcttanaaacaatttttgaaaactggactcacgcggtggcgcgctctaaactagtggatcccccgggctgcttgattcgtctcacccctagaaaaagcacactagagcgagctgccacagacaaggacacaatgccacccatacccaagagaggcgagcatctcctggtcctcctaattgtcgcatgcgctgccacagctctccaccgctcgccggcaccgatccccttctacccgttccgtcggagtccgaccgccgcacgcgcactgacgacggcacgcttgttacccggagcctctgcccggttcgacactcggcggaacatccccgggaaccctacgcaaagaaagccggttccccgggaacgttcaatattttgggggtcggacgccggggaaaaaacccggcacacccaaagggtgaaattgtgggagggggggactggaccaccccccttttccttgggggagaaaaaaatggggggcggcagaggaggtagaaaataaaaatactcagaagaagaaagcaggaaaaacaccccaacccaagcaaaaagacaacacacccttaaattggcttttttatagtacaatccctcctcttctagttgtacgctctttctcagttaaagacacaatggtggatccaaatgtcatagttttggcggtgggggagagcggaactaccgggatgttttcgtgcgaagaagagtcaatattattgacgaaagaatcttactggtctggtgtcgtacctctcaagacgacagatagttgcaaaacagtaaggttgcgctcccgtcttcttcttctgtgaattgacagaagcgtagaccatattgtggatagaaagactatagtgaggggggagagaagtcaattggatgagtaagggtactcttactggacggtatataattccggttcataagataggaaacgattgtaccccactaggataggcgtctaggcccgaacaacctctccgagttgggtggtgtgtttgtaattgacaaagcacaaccttgaagatcaatcatgtaagatnatagtatgtgagtggagtgggaaatgataaactccgaaaat

SEQ ID NO: 87274 - DNA, 774 bp, Zea mays
  misc_feature: Ceres CLONE 1574239
  misc_feature: Translation starting site: 85
  misc_feature (755)..(755): n is a, c, t, g, unknown, or other
  misc_feature (756)..(756): n is a, c, t, g, unknown, or other
ctggagctcaccgcggtggcggccgctctagaactagtggatcccccgggctgcaggaattcgtctcacccctagaaaaaattgatggacaaggaactcaagctgcatcccacagttgactgtttctgcagtggatctacggcagtaacattggtgaaacaggtgattgatatttcaaaacttaccttggtgtttgcacatactgaagtttttgacagaagtggtagaagtacaactaaattactgaatgagctagacatgtttttgttagggattggaccttgtaatcggaaatcttggggactcaagagcaattatggggacaagagacgcctctaacaatctaactgctctgcaactcacagttgatttgaagcctaaccttcccagtatgttcaattcttactttgatcatttcattgaccctgaaggacgtctgaatctgcatatttgctctttctttcctctctggtcctcgagggtgccttttgttccaacctatgacacccaattaagattccttgttcccccacacatggggggtgtttcccccccttggggggggggtggggccaaaaaattttaacccccttttttcttctctttttggggggaaaaggcggggaaaaaacacccttttttaaggggggggggttttttttcctctaggagaagaaacaaaaattattctcccggggggggggtgggccccaaaaaaaaaaaaccccccccccccctttagttgaaagaaagannaaacacaaacccaccccc

SEQ ID NO: 87275 - DNA, 848 bp, Zea mays
  misc_feature: Ceres CLONE 1574240
  misc_feature: Encodes the peptide sequence at SEQ ID NO. 87276
  misc_feature (657)..(657): n is a, c, t, g, unknown, or other
aaagctggagctccccgcggtggcggccgctctagaactagtggatcccccgggctgcaggaattcgtctcacccctagaaaaaatttcccatctcgccttcgcttcccacgcccctccgtcccgcctcgccgcggcgaggcaccgccgccaaccgccctcgtccctcttcgactcgaccgcgtgagtgagacgaccgcgcgcgcccctcgcccgcccgccaggaggagatcgacccccgaacgcgtcatgaaatacgtgctggtgaccggcggcgtggtgagcgggctcgggaagggcgtgacggccagcagcgtcggggtcgtcctcaagtcctgcggcctccgcgtcacctccatcaagatcgatccatacctcaacatcgatgccggaaccatgtctccgccccagcatggcgaagtgtttgttttggacgacggcggtgaggtggacttggaccttggaaactacgaacgatttctggacatcaagctgactcgtgacaacaacataaccacggggaagatctaccagtctgttattgacaaggaacgtacaggggattaccgaggaaaaactgttcaggttgtgccgcacatcacagatgaaatacaagagtggattgaacgtgtggcaatgaatccagttgatggcacanaagacccagctgatgtttgtgtcatagaacttggtggcactataggggacattggatcaattggctttcattaaagcattaggtccatttgccataccgggttggggcctgggaaacctccggcttggtgccatgtcaagcctggtacctttctttaaatgacggttggtgaacgcaaaaaaccaaggcct

SEQ ID NO: 87276 - protein, 160 aa, Zea mays
  misc_feature: Ceres CLONE 1574240
  misc_feature (1)..(161): Pfam Name: CTP_synth_N Pfam Description: CTP synthase N-terminus
  misc_feature: SWISSPROT Homolog: EC 6.3.4.2 CTP synthase
  misc_feature (137)..(137): Xaa is any aa, unknown, or other
MKYVLVTGGVVSGLGKGVTASSVGVVLKSCGLRVTSIKIDPYLNIDAGTMSPPQHGEVFVLDDGGEVDLDLGNYERFLDIKLTRDNNITTGKIYQSVIDKERTGDYRGKTVQVVPHITDEIQEWIERVAMNPVDGTXDPADVCVIELGGTIGDIGSIGFH

SEQ ID NO: 87277 - DNA, 1183 bp, Zea mays
  misc_feature: Ceres CLONE 1574245
  misc_feature: Encodes the peptide sequence at SEQ ID NO. 87278
  misc_feature (69)..(69): n is a, c, t, g, unknown, or other
  misc_feature (455)..(455): n is a, c, t, g, unknown, or other
  misc_feature (864)..(864): n is a, c, t, g, unknown, or other
aaacattatttgaaggaggtcaattctaataggacaaggaactatggtgtaacaggcacaatatatttnttttttttcaaactggagctccccgcggtggcggccgctctagactagtggatcccccgggctgcaggaattcgtctcacccctagaaaaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacgggggcgcgcgcacccgcaccaagaagaggaagaaaccatgtcccccaacctggacagcgccatcaagagccaggtggcggcgctgctcctgttcccccccccccccccgncccgggggggacgagggccaacagcctccagcggaaccccgggcgcctgtgggggaaagccgaagggtggttccctgctgaaccgggaaacccgggcctgccgtgcctcccggcatgggaagcctgggtacccccccgggggaaacaacggcggcctttatccggttccaaatcgcccccagggcttggaatacccctcccgcttttttacaaacaatttggcccctccccccgggggggtggggaaccccctccggggttttcaacctcctttctacatcgaggagaaaaaagcgcaatcatatcccctctgggggtatagaaaacaatgtttagacttcccctccccccccctctttttatatttttgagcggcccccccgcggggaatattgtgccctcacgcgcngtgtcaatagaacaggagtttcaccaccctcacggggtgtgaaaaaagaggcgttaaataaccaaaacgacacggagaataagtctaggttggtgtctaccaccccacccacccggtgggtggtatacacattggggcgacacccgcgggggtctgacttcaatgaaagagaaaatttgttttctagagcggcgcgccccggacagaaatgcttgcttctcagcctacgccggcgtcctgtggtgagtatatataaaaaaagggcgaccgtggtgcgtgagtcgtccccacacacgatcaatattcgtgtatgtgcccg

SEQ ID NO: 87278 - protein, 147 aa, Zea mays
  misc_feature: Ceres CLONE 1574245
  misc_feature (25)..(25): Xaa is any aa, unknown, or other
MSPNLDSAIKSQVAALLLFPPPPPXRGGRGPTASSGTPGACGGKPKGGSLLNRETRACRASRHGKPGYPPGGNNGGLYPVPNRPQGLEYPSRFFTNNLAPPPGGVGNPLRGFQPPFYIEEKKAQSYPLWGYRKQCLDFPSPPLFLYF

SEQ ID NO: 87279 - DNA, 815 bp, Zea mays
  misc_feature: Ceres CLONE 1574249
  misc_feature: Encodes the peptide sequence at SEQ ID NO. 87280
  misc_feature (648)..(648): n is a, c, t, g, unknown, or other
  misc_feature (649)..(649): n is a, c, t, g, unknown, or other
  misc_feature (654)..(654): n is a, c, t, g, unknown, or other
  misc_feature (655)..(655): n is a, c, t, g, unknown, or other
  misc_feature (664)..(664): n is a, c, t, g, unknown, or other
  misc_feature (665)..(665): n is a, c, t, g, unknown, or other
  misc_feature (750)..(750): n is a, c, t, g, unknown, or other
caaagctggagctccccgcggtggcggccgctctagaactagtggatcccccgggctgcaggaattcgtctcacccctagaaaaacgtggtatacagcagcagaagcagcatcacgatcccggcccggcggcgcgtacgtcgacgaggaggaggaggacgtacgtacgcagagcagctgctggcaccatggctcccgtgagcatcagcgctgttccgttcctcccgacggcggcggagggggagacgaagctgcgcgcgtcgttcgtgcgcgaggaggacgagcgccccaaggtgccgcacgaccgcttcagcgacgaggtgccggtggtgtcgctcgagggcatcgacggcgcgcggcgggccgagatccgcgcgcgcgtggccgcggcctgcgaggactggggcatcttccaggtggtggaccacggcgtggacgccgcgctcgtggccgacatggcgcgcctcgcgcgcgacttcttcgcgctcccgcccgaggacaagctccgcttcgacatgtccggcgggaagaagggcggcttcatcgtctccagccacctccaggggggaggcggtgcagggactggcgtgagatcgtgacctacttctcgtacccggtgaaggcccgcgactactccggtggccgacanncggcnngctgcggcnngtgtgaaacgtacacgagcactgatgcgctgcgtgcagctcctggcgtgctctcgaggcatgggctgacacgagcgctgccaggnctgcttgaatgacaaaaagtgtgcactttaccgagtgcgcagcgactcagctgggtcaggccacc

SEQ ID NO: 87280 - protein, 136 aa, Zea mays
  misc_feature: Ceres CLONE 1574249
  misc_feature: SWISSPROT Homolog: EC 1.14.11.9 Flavanone 3-dioxygenase
MAPVSISAVPFLPTAAEGETKLRASFVREEDERPKVPHDRFSDEVPVVSLEGIDGARRAEIRARVAAACEDWGIFQVVDHGVDAALVADMARLARDFFALPPEDKLRFDMSGGKKGGFIVSSHLQGGGGAGTGVRS

SEQ ID NO: 87281 - DNA, 823 bp, Zea mays
  misc_feature: Ceres CLONE 1574250
  misc_feature: Translation starting site: 208
  misc_feature: SWISSPROT Homolog: EC 5.3.99.8 Capsanthin/capsorubin synthase
ctccccgcggtggcggccgctctagaactagtggatcccccgggctgcaggaattcgtctcacccctagaaaaaatagctgcagcagccaagtcctctccgctctcttcgccgccaccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagccagtccaagatcgcttccaagctatcgcccatatctgatgaaaatacagtgcttgatttggttatcattggttgtggtccagctggtctttctctagcttcagagtcggctaagaaaggtctcactgtaggtctcattgggcctgaccttccattcacaaataactatggtgtgtggggaagatgaaatttaaagatctcggtctagagagctgtatcgagcatgtctgggaggatactattgtctacctagacaataacagccgatactgattggccgttcttatggcaaggtgcaccgtgacttgctccatgaggagctg

SEQ ID NO: 87282 - DNA, 1212 bp, Zea mays
  misc_feature: Ceres CLONE 1574251
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (63)..(63): n is a, c, t, g, unknown, or other
  misc_feature (912)..(912): n is a, c, t, g, unknown, or other
  misc_feature (1026)..(1026): n is a, c, t, g, unknown, or other
  misc_feature (1199)..(1199): n is a, c, t, g, unknown, or other
tttttttttttnngntnnctgttgggtgtattattgactctagcaagtgttatatttttattnggtgtgtttttcaaactggagctcaccgcggtggcggccgctctagaatagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcacgttcaaaacaaactcacagcgtcaaggctgcggtgatctctgaacgcgtctacaactaccgcatctccaagcagctgaaggggggccaccgtatcttgctggctaaagtctcgtacccaacgggcaacaaccggtcccggcgggttccccaagcaatgtgggaaataaaaaaaaccctttaagagaccgtaggcccccccccccccccaaaccaagaaataaatattgggggaaaaagaaagccccaacaacaaagaccgcccccctttaaaaccaatccgagggaaagtggaaaacttaaatctttccatcaaagagggcgggggctgaaaataaatgggggggaagtgttgaacgccacgcccgtagggggcacgaggtaggggtctcactcctggtcataatatcacaaacaactgtggtcacaagagtaaatcttctttatgaaaacacccactctttttctaaaaaaagtgaggtgatacagcccactcccccaaatgaaataaagatgtaaacgacctcacactatataaaaaagatatattaaatagtttgtcccccactactaaagggagaggagtataccatatagtataaagaacaggcaaattctactagaaataaactttatttgacactgtcgaggtagtaaattgnaagacgccacccacaataatatttacaagagcggactcgacccgcccctaaacaaagtaaagcggcaccgcgggggccgaaagataaaccgcactttggtatttgctattcacnacgcaaatataacttgctttcggtctgacccgtcatgttcggcaaagaacacaacagagaaagtagcctctaggagagatgggagcaaatgataggacccgattgaccaaaactcagataaggttaatagaaactacgacccccctgtgcaaattaaaaataaattaccatcncaaccttatagat

SEQ ID NO: 87283 - DNA, 1096 bp, Zea mays
  misc_feature: Ceres CLONE 1574253
  misc_feature: Encodes the peptide sequence at SEQ ID NO. 87284
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (27)..(27): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (53)..(53): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
gggggggggnnnnnctttncctccccnccaccccannanaaaccacaccccanaannnnaaaaaaannnaaaaactgggactccccgcggtggcggccgctctagaatagtggatcccccgggctgcaggaattcgtctcacccctagaaaagctgcctccgtctgacggctcgaagctccctccagttccgatctaaacccgccgaaaccctaatccccatggctgccgccatgggcaaccccatcctgaccctccccgcaccggagggcaacggcaccgggggcggcgacgccgaccagcagctgcagcaggcgccgcctaagccgcctcctcccggcgcgaagacggaccccccggcgacggtggccacccacacgcgcaccatcggcatcatccaccctccgcccgacatccgcgtcatcatcgagaagacggctaccttcgtcgccaagaacgggtgtgagcccccctggcgcatcatctccctcaaccagggcaacgccaaattcaacttcctgcagccctcggatccctaccacgccctactaccaagcaccgcggtttccagagatagccgcctgcgccgccccggggccggacggccccctcggggcggccgatactgggcggcgtgctccccgaccgaaatcgcccagcggttcggccccccgggcccgaagggggggccggcccgcccggccatccccgttaaaattggggcaaccttgccttgcccggaaacggccaaatagggggccgggaattaaacttccccggcgggcaccttttttccgaccgtggggggggggacccccccaccccccaaagggggtgccttggggtgggcccacccccccaaaggggctggaataaccttgttatccacacagggtgtgcggggtcccttgcccccccaaaagggggttatttccacacccgaggtggaaaggggaagctctgggcggacctcttcctatttccagagagcgtgagaaccccggcccaccaatatttttgatttggggcacccccgcgtaaacacggggggggaaaggaaaaccactttccccgtgagaaacgaaaagcccactctg

SEQ ID NO: 87284 - protein, 177 aa, Zea mays
  misc_feature: Ceres CLONE 1574253
  misc_feature (69)..(110): Pfam Name: Surp Pfam Description: Surp module
MAAAMGNPILTLPAPEGNGTGGGDADQQLQQAPPKPPPPGAKTDPPATVATHTRTIGIIHPPPDIRVIIEKTATFVAKNGCEPPWRIISLNQGNAKFNFLQPSDPYHALLPSTAVSRDSRLRRPGAGRPPRGGRYWAACSPTEIAQRFGPPGPKGGPARPAIPVKIGATLPCPETAK

SEQ ID NO: 87285 - DNA, 831 bp, Zea mays
  misc_feature: Ceres CLONE 1574257
  misc_feature: Encodes the peptide sequence at SEQ ID NO. 87286
ctggagctcaccgcggtggcggccgctctagaactagtggatcccccgggctgcaggaattcgtctcacccctagaaaaagacgacgtccgcgccacgcgcgggcggaacttcctagtttgcgacggggcacgcacgcaagacgcaccccaagcttcaactatatataaaaagcaccccccgcgagcgcggccggccggcgaacagaggagaggagaggagagactagacccgctagctgaggccgggcggcgcgctggacacgaacatgatggggagaaaggcgctcggctgtgctcctcttctcctcctcttggccgccgccgtcgctccggccgagctcagcgtcggggcggcggctgcctcgggcgcggtcacccgggccgacttccccgcggggttcgtcttcggcgtcggctcctccgcgtaccaggtcgaaggtgcagttgcagaggacggaaggaagcctagcatctgggacacattcacacatgaaggctattcccttgacaacgccacaggcgatgtaactgcggatcagtatcataagtacaaggacgacgtaaagcttctgcatgagatgggtgtcgatgcctaccggatgtcgattgcctggcctcgacttatcccagatggtcggggagccgtgaatccgaaggggctggagtactacaacaatctcatagatgagctccttagctacggaatacagcctcacgtgacgatataccatttcgatttcccacaggctcttcaggacgagtacagcgggctgatcagtcccagattcatagaggactcacgcgtacgcaacttgctcacacttcggact

SEQ ID NO: 87286 - protein, 188 aa, Zea mays
  misc_feature: Ceres CLONE 1574257
  misc_feature (37)..(187): Pfam Name: Glyco_hydro_1 Pfam Description: Glycosyl hydrolase family 1
  misc_feature: SWISSPROT Homolog: EC 3.2.1.21 Beta-glucosidase
MMGRKALGCAPLLLLLAAAVAPAELSVGAAAASGAVTRADFPAGFVFGVGSSAYQVEGAVAEDGRKPSIWDTFTHEGYSLDNATGDVTADQYHKYKDDVKLLHEMGVDAYRMSIAWPRLIPDGRGAVNPKGLEYYNNLIDELLSYGIQPHVTIYHFDFPQALQDEYSGLISPRFIEDSRVRNLLTLRT

SEQ ID NO: 87287 - DNA, 861 bp, Zea mays
  misc_feature: Ceres CLONE 1574258
  misc_feature: Encodes the peptide sequence at SEQ ID NO. 87288
ctggagctccccgcggtggcggccgctctagaactagtggatcccccgggctgcaggaattcgtctcacccctagaaaaaggtgttcgctttagagccttcccgcaagcagccgaattcctccccaattccttcctcgatgctgcggcttaacaacgagtgtgatatcgagtacgatgtctgacgcgattcacatggcatctatgtgttatacgtgtgagctgctctcctcgtatggatccagatgttctcatggaacggtatgcagtcctactactccgggttgatctctccttcgctcctcctttggaccgaccgccgcagcctgtgcgtgactcctacatggactacgacagcaccctccgccgtgggatccggatcaggagacgcatgacagatctttgtgatggatctgcacgcagcaagactataacccgtcgacgtagcgagtcctgtgaccaggggtgtccatgtcaatggccacatcctggacaatgacggcatccctccacaccaacagctcctcatgtttggtggtaagcagtttgaggaccgtagacctcttgcctgactacggacttccgaatgagagcgacctccaattggtactgcgactaacgctatgcatgcatatgtttctgaagaccctgaagatgtaaaactatcaccctcgaggctggaacgttcagacatcatcgatctaagtcaggccttgatccacgataaggaggggattcgtccagaacagcagaggatcatctttaatggaaagctgttttatgaccggcgcatgctggccggactcgacttcctgaatgagacatctctgcatttggtgctgcggctcgagggatgcatgcag

SEQ ID NO: 87288 - protein, 80 aa, Zea mays
  misc_feature: Ceres CLONE 1574258
MHAYVSEDPEDVKLSPSRLERSDIIDLSQALIHDKEGIRPEQQRIIFNGKLFYDRRMLAGLDFLNETSLHLVLRLEGCMQ

SEQ ID NO: 87289 - DNA, 820 bp, Zea mays
  misc_feature: Ceres CLONE 1574262
  misc_feature: Encodes the peptide sequence at SEQ ID NO. 87290
  misc_feature (806)..(806): n is a, c, t, g, unknown, or other
  misc_feature (813)..(813): n is a, c, t, g, unknown, or other
ctggagctccccgcggtggcggccgctctagaactagtggatcccccgggctgcaggaattcgtctcacccctagaaaaaagggctaccccataaaaacgcccacgacggcgactggcctttcgattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaaggtagcaccttgcttggattcaagggaggccctgctgggatcatgaagtgcaaatatgtggaactcacttcagactttgtgtatccctacagaaaccagggcggattcgatatgatctgcagtggaagggacaagattgaaacaccggagcagttcaagcaagctgaagaacagccaacaagcttgatttggatggacttgttgtcattgggtggtgatgattcaaacaccaatgccntgcctcntggtgaa

SEQ ID NO: 87290 - protein, 207 aa, Zea mays
  misc_feature: Ceres CLONE 1574262
  misc_feature: SWISSPROT Homolog: EC 2.7.1.90 Diphosphate--fructose-6-phosphate 1-phosphotransferase
  misc_feature (203)..(203): Xaa is any aa, unknown, or other
  misc_feature (205)..(205): Xaa is any aa, unknown, or other
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPYRNQGGFDMICSGRDKIETPEQFKQAEEQPTSLIWMDLLSLGGDDSNTNAXPXGE

SEQ ID NO: 87291 - DNA, 877 bp, Zea mays
  misc_feature: Ceres CLONE 1574264
  misc_feature: Encodes the peptide sequence at SEQ ID NO. 87292
  misc_feature (448)..(448): n is a, c, t, g, unknown, or other
  misc_feature (497)..(497): n is a, c, t, g, unknown, or other
ctggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcagcttcgttaccttctcctccgagaactccatgctcgacgctatcgagaacatgaacggcaaggagctcgacggccgtaacatcaccgttaaccatgcccagtcccgtgtctgtgacggtggcggcngtggctacggcggctgtcgctgcggcagccgctatgattgcgggcgccntgacagcggttatggcggcggtggcggctacggccgttcggccctaagggtgtggccgccgcctacggaaggcgtggggggctatcgccgtcgggcctaagggtgggtgttgggggcttacctttgccaacgacaaacggtggaggaacttaaggtgtggccccttcctgggtttgggcaaagtttccttttttacccttaggaagggggtttcccattggcttttgtgaccccgttttaaggccccctccccccttaaaaaaaaagggggggaacccccctgttttccccctttgtgtgccccccccttttaaccgaggggggaaaaaaattggggcttcccggggggtttttttttttttcccccctttttttttttt

SEQ ID NO: 87292 - protein, 142 aa, Zea mays
  misc_feature: Ceres CLONE 1574264
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (94)..(94): Xaa is any aa, unknown, or other
  misc_feature (110)..(110): Xaa is any aa, unknown, or other
MAAADVEYRCFVGGLAWATSNESLENAFASYGEILDSKVITDRETGRSRGFSFVTFSSENSMLDAIENMNGKELDGRNITVNHAQSRVCDGGGXGYGGCRCGSRYDCGRXDSGYGGGGGYGRSALRVWPPPTEGVGGYRRRA

SEQ ID NO: 87293 - DNA, 754 bp, Zea mays
  misc_feature: Ceres CLONE 1574265
  misc_feature (360)..(360): n is a, c, t, g, unknown, or other
  misc_feature (409)..(409): n is a, c, t, g, unknown, or other
ctggagctccccgcggtggcggccgctctagaactagtggatcccccgggctgcaggaattcgtctcacccctagaaaaacccaatcccaccgccagtctccccccgcgcctcagaagtcagaaccctagccccggcgacgccttcagatccggtgccctatcaggcggaatcgctcgctcctaccaccggttgccgcgttccggcatctcggctacccggcgtcctctacccgacttctacgccctcgatctcccccagccgtcgtcacgaggaatcgtttgctccacaggctacgtctccaccaagccagcgtcgacgactcgaaggatccgtgccgtcgtcgatcgccgatcgcctncttcgtagatcgaatctgttcagtgttttgctattcgttggtatttcantctgaatatctgaaaaaaagtattcggggccatcctcgagattagaagaggcccttccttaggcgggaaaaaaaagaaaacgggacccgcccatccatcatgggggggtgggcctatttccccatttttagaagtggaaaagggaaattttggtttttattgccaggggccccccatggccttttttatttcggggggggcgggaaacccccaggccccttttttttttttaaaaaaaaaaggggggaagggcccccccgcccccccggggtgtttaaaaaaaaaccccccgccgggggggggttgggggcccccaaacaaaaagagaaaaataatttttttttt

SEQ ID NO: 87294 - DNA, 826 bp, Zea mays
  misc_feature: Ceres CLONE 1574269
  misc_feature: Encodes the peptide sequence at SEQ ID NO. 87295
ctggagctcaccgcggtggcggccgctctagaactagtggatcccccgggctgcaggaattcgtctcacccctagaaaaatccccaattactcgctcaaaccctagccccaccgcgcgaatggccgatgtgcttgacccggcctccgacgcgccgcgcgcgcgccgtccgccgccacctcccccggatagcccggaggaccgctcgccgcagctgcccccgcctccacccgggggccccccggcggcgagccggaagcggagtcgctctccgccgccgccgccgccgcctccgctgggttcgtcccggccccaaaggtatcgggaccaccgcagcggcggaggggcggggcgggagcagccccagcccgccgccgtaccggggcagccgccgccactcgccgtccaggagatccccgtcgccgccattcaagcggtcgcggagggacgacgggtacgaccgccgcgggggccgcgggagcccgccgcgttacgggtacgatgataggaggcgaggttatgaccatgagcgaggtggcggcagaggtgggtatgaagatgacaggaaccagggcagatatctgaaccgtgctccagattggcctgattcggggtacggagcggccaatgatggtccaggggtcacccaaagggaaagggttgatgacatacaaacagttcatgcaagttcttgaggatgatatttcacccagtgaagctgaacgcaggtaccaagaggatagaactgagtatatcactacccagaaacgtggctatttttgatctcaaccagaatggaagattgggttaaaagacaagtaccaccca

SEQ ID NO: 87295 - protein, 188 aa, Zea mays
  misc_feature: Ceres CLONE 1574269
MCLTRPPTRRARAVRRHLPRIARRTARRSCPRLHPGAPRRRAGSGVALRRRRRRLRWVRPGPKGIGTTAAAEGRGGSSPSPPPYRGSRRHSPSRRSPSPPFKRSRRDDGYDRRGGRGSPPRYGYDDRRRGYDHERGGGRGGYEDDRNQGRYLNRAPDWPDSGYGAANDGPGVTQRERVDDIQTVHASS

SEQ ID NO: 87296 - DNA, 740 bp, Zea mays
  misc_feature: Ceres CLONE 1574271
  misc_feature: Encodes the peptide sequence at SEQ ID NO. 87297
ctggagctccccgcggtggcggccgctctagaatagtggatcccccgggctgcaggaattcgtctcacccctagaaaaaatactccgctgcgcgctccgagctcaattccccgcgcgcccagccccgagctcaatcccccgcgcgcggccccgagacttaatattcgttcacccgtcgattccgcctccgatcccctccctccttccgttgcggagactcccgcttctgcggcggaggccaagcaggagtcggtgttggagacggaggaaactaagcaggcggtggcagcagcagcagcagcggcaggaggtgtgcaggccatggcggtcaccgtagtgcgggacgtcgagacgggtctggacacgagtaccagcgtaccaggacgggcgacaagccctttcctggttcacaccctaagaggtaaatccccccccaaaccccgtaggcaggaaagctcgatttgagagtacccaatcggtcgttaaggctccgggctggggggtaaggcctttttatcctggtttcccggtttacattcctggggtttggaaggaacctccttaaagggccgggtggttttaaaccctttgggggttttggggggccgaaattttgcgcatgggcctgggggttttgggttccccataagggggaattttttttttttgggccctttcccccccctggggagggcccccccccaaaatttggtgggggcccggcataaaccctggggggg

SEQ ID NO: 87297 - protein, 47 aa, Zea mays
  misc_feature: Ceres CLONE 1574271
MAVTVVRDVETGLDTSTSVPGRATSPFLVHTLRGKSPPKPRRQESSI

SEQ ID NO: 87298 - DNA, 806 bp, Zea mays
  misc_feature: Ceres CLONE 1574273
  misc_feature: Encodes the peptide sequence at SEQ ID NO. 87299
aaagctggagctccccgcggtggcggccgctctagaactagtggatcccccgggctgcaggaattcgtctcacccctagaaaaaaacgcgcaacggggggcaaagcctcaaaagagacagttggaggccggccatccattgctggatccatctgttgttcaaggctgcttattctgcgacgaggtgaaacttgctttccttgctggcaacatatccacctccaggtgcctacggtgtgcgtagcgccttagcctcgctattagccagcgcgcgctaagcaggcgggcatccatgggttcttgcctgtctgtgtcgtctacgatgcaccagcggccgacgacgacgaagctgtcggccacgtcgaggaacttccggcggaagctgtccacaggaatccccgcccacccgccaatattccgcggctccggcagctcggcgacctgcctcgcccggtacggggtcgtccacgtggaggcgccggactccaacgtcaccctgcgcctcaccaagctgcagtggcagcacagccagatggactcccggagcgagattttgccaataagcgtggtacgattctgtcagcatcctgtagtcaccggactccgacaacaatctcgacaacaatttcactagcgtcagcggagaccctctccctgatgtcaccggcggctcggacgcacccaactgcaaggaggtagcgtgcttcttggacaccatgcagctcctcttgagcatcgcaaacgctgaaccatacgaccaaagtgaaaaacctcgctgactagagtgactactacaactcgaacgtt

SEQ ID NO: 87299 - protein, 113 aa, Zea mays
  misc_feature: Ceres CLONE 1574273
MGSCLSVSSTMHQRPTTTKLSATSRNFRRKLSTGIPAHPPIFRGSGSSATCLARYGVVHVEAPDSNVTLRLTKLQWQHSQMDSRSEILPISVVRFCQHPVVTGLRQQSRQQFH

SEQ ID NO: 87300 - DNA, 844 bp, Zea mays
  misc_feature: Ceres CLONE 1574282
  misc_feature (710)..(710): n is a, c, t, g, unknown, or other
aaagctggagctcaccgcggtggcggccgctctagaactagtggatcccccgggctgcaggaattcgtctcacccctagaaaaatcctccacgcgaatccgcatctccagactccaaccagcgctcgtccctccccgttctttcctcctcccttcagccatcgcagtcgcagcgcaggttcttggctggttgctggtgtcgacagcaaagtccgcaactccaatcctgcctgcgctcctcccgtcctcactcagcacccgcgcacgccgcctgcctgtcgattgagatctctttcacgcccctttctgccatcgcacaactgaggtacggttctttgcttattgcagagtatagtatggatgcccgcagtgagtcgtcgtgtcgtgccttcagtaggaggtacggtacttgtgctgtaggagcagttcataagtcgccacactgttttcaggaaatgacagtctttgtgtgtgtatttcatagatctagagcattcactgtcttgtccctttgcagccgcagctacgatactattaacatcaatttgtctggtcaataaatcactcggagcaatcgtgcgagtctttgtgtgtgtatttcattgatctcgagcactcactgttttgtgcctttgcagccgcagctagtaacatccattttgctggtcaataagtcgtgggaggaagaagatggattatttgaaggtgcanggtggtagagtcatcatttgtagtgccgagcgagccgacgccaacgaaggcgctctggctctcttgcttggacatggttcagtccaacaaagcccacaccccaacgatccacttgtacagctccaacgatgctg

SEQ ID NO: 87301 - DNA, 967 bp, Zea mays
  misc_feature: Ceres CLONE 1574284
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (287)..(287): n is a, c, t, g, unknown, or other
  misc_feature (326)..(326): n is a, c, t, g, unknown, or other
  misc_feature (334)..(334): n is a, c, t, g, unknown, or other
  misc_feature (386)..(386): n is a, c, t, g, unknown, or other
  misc_feature (413)..(413): n is a, c, t, g, unknown, or other
  misc_feature (414)..(414): n is a, c, t, g, unknown, or other
nnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggggactccacctcggntgggcgagccgctctagaaactagtggaatcccccgggnctgcaggnaaattcgtctcacccctagaaaaagtccccaacccacgcactgcccaccggntctctctcacacaacacagggaatatnnaagcccagtccacgagatctcccgtagaccagtggcgagggaagggaaggaacgaaacagagcccgatcctagcgacagggcagggaagatcgccatgatgatgatgggcgaaggcgtgagcgtgccgccgtggtcccaccacgtccccgtgagcggcgtcgacgtcggcgtccgcggagacgaagatgaacgccgttaccctaactgggcggcccctgcccggccagttaaccctggcccgggggcaaaacgaaacgcccggggcgccccgccccgaaaggccgggaaccaaaacaaaaggaaagggccgggcccgggccccaattggggccccccccggggccctttggaaaacgggggtttaaccggggctttggcaaaaacaaaaaattccccccccaatggtaaaaccaaaaattttcaaaaagggtcccccgggggcgggggtgggccggccccccgggggggggcgggcaaaaaccccccccaaaaatgggggaaaccccgaaaaagttgcccccccctttttggggggggaaaaccccggggggg

SEQ ID NO: 87302 - DNA, 820 bp, Zea mays
  misc_feature: Ceres CLONE 1574285
  misc_feature: Encodes the peptide sequence at SEQ ID NO. 87303
ctggagctccccgcggtggcggccgctctagaactagtggatcccccgggctgcaggaattcgtctcacccctagaaaaaaccaccctcacacttcgccctcctcccggcgaggtcgcctctgcttccgactgcgcccgaccccagtctcgcctgcgtccaccggcatggcctcacccacggtcgcctccccgacccgggcgagccccgccgacatccccaccgccgcaccctcgtcggccccccggccgcggcgcctcgcgtcggcgccgcccgcagtctacgcgtctgcgtcctcctccccggcctccgcctactccggggaccagctctccgcccccgacgcctcgagcccgctgctcgcgagcaggagcgaggagtacaggcttctgttccggctgccgcccgacgaggttctcgtgcaagattttaactgcgctctccaagaaaatatccttcttcaggggcatatgtatttatttcttcaccatatatgcttctactctaacatatttggatatgagactaagaaaacaatacctttgcaagaggtaacagatgttcgtaaagcaaagacggctgccattttttctaatgccattgaaattgttgctggtagtagaaggcacttctttggatctttcttgtcacgtgatgaagcctatcaaattatagtagatggctgggaacaacatgttagtaatgcaagattgctccttgaacgtcaggagacaaagtcagctagtagcagtgaagaaaatggttatgttttattggaaggagcacaggaacctaaacaagatgaagattcatcacccgct

SEQ ID NO: 87303 - protein, 218 aa, Zea mays
  misc_feature: Ceres CLONE 1574285
  misc_feature (70)..(136): Pfam Name: GRAM Pfam Description: GRAM domain
  misc_feature: SWISSPROT Homolog: EC 2.4.1.173 Sterol 3-beta-glucosyltransferase
MASPTVASPTRASPADIPTAAPSSAPRPRRLASAPPAVYASASSSPASAYSGDQLSAPDASSPLLASRSEEYRLLFRLPPDEVLVQDFNCALQENILLQGHMYLFLHHICFYSNIFGYETKKTIPLQEVTDVRKAKTAAIFSNAIEIVAGSRRHFFGSFLSRDEAYQIIVDGWEQHVSNARLLLERQETKSASSSEENGYVLLEGAQEPKQDEDSSPA

SEQ ID NO: 87304 - DNA, 782 bp, Zea mays
  misc_feature: Ceres CLONE 1574286
  misc_feature: Encodes the peptide sequence at SEQ ID NO. 87305
ctggagctcaccgcggtggcggccgctctagaactagtggatcccccgggctgcaggaattcgtctcacccctagaaaaatccagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctccttccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacatgatggccgccgcgccgccgcccaaggccgacgagctcccgccgttcccgcccaaagagcagctgcccggcgtcgccttctgcatcaccagccccccgcccatggcccggaaggccatccttgcttggggttcccagcattttcgtc

SEQ ID NO: 87305 - protein, 48 aa, Zea mays
  misc_feature: Ceres CLONE 1574286
MAAAPPPKADELPPFPPKEQLPGVAFCITSPPPMARKAILAWGSQHFR

SEQ ID NO: 87306 - DNA, 908 bp, Zea mays
  misc_feature: Ceres CLONE 1574287
ctccccgcggtggcggccgctctagaactagtggatcccccgggctgcaggaattcgtctcacccctagaaaaattcgcttcgtttattccccacttccacatcggccacgccgccacagccgccgccgccggacggcgctgtccttccctgggaggcgctccactaggctcggctcagctcacgcgcggcggcggtgtccgtggctgctgggcttgcgcgcgcacctgattccgtgctgggcttcgcgaggtgctcctcgtgcgagacacacgcccgatgcggcggaatcgcgcggccggcgcccgagacccggcgtgattcggtggggaggctgggtcgcggtgcttccgcgtgcgggaaccactgacttttttattcttctcttccccagtggctcgggcggctagcgggcgggccgcttggtgctcgtcagcgcgtgaggcggagattacccggcgccgatctggtgctcttgccgcccggaaaggtggtgcccggggccattggcgggttctgattaagaggaggccgatgatgtaagtcccttgtcttatggggctcgctcctccggatctggggcagttctacgggtgtgatagctcccgggcagtgagagggaacctctgggccttgttgccgccatcacccgacctttttctggcatttcgtcgcttcctgaaatgccagatgttaaacaaacaaacgaccccctgcacactccatcctggaggctcgaattccaccctgagggtgcctatgggggaaccatttttccgcctgcccgattaacctgccttacctagcggctcttatgggtcgagagaggctcctaaaactcttcacaccgttggacgtgatagttttttaaagttccgcgcgtgtggtaagttaataaagaggcctaaa

SEQ ID NO: 87307 - DNA, 832 bp, Zea mays
  misc_feature: Ceres CLONE 1574288
  misc_feature: Translation starting site: 227
  misc_feature (610)..(610): n is a, c, t, g, unknown, or other
  misc_feature (645)..(645): n is a, c, t, g, unknown, or other
  misc_feature (716)..(716): n is a, c, t, g, unknown, or other
ctggagctccccgcggtggcggccgctctagaactagtggatcccccgggctgcaggaattcgtctcacccctagaaaaaagccagctcgaccgacgagacgacaacgccgccgcgccgcgcgcacgcccgacgccgacgccgacgccgacgacgacacgccctccgcccggtcccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgggcctcctcgaccgcggcgccacctccctcgtccgctgcaccttccgcgactcctgcccgccgccgaaccagcagctctcacggaaggtaagctgggaggcgtggcggcgaacaaggtagcggaggaggagcgcatcgtgaacgcggggcgcgcgccggccatgttcgacgagctccggggccggctgcggatggggctggtgaacatcgggcgcgacgagctgctggcgctgggcgtggagggcgacncggtgcgcgtggacttcgagcgcgtgtcggacgcngtccggtggtcggaccctgttccgggagtggatcgacgagggagaggacgacgagggcccgtcctgccggnagctgcccatgcccgactgggcccggtacggcggcgacgtggactgtggtgggggggttccctgcccgggcaacggccagcgggccccgggtggaaaccgcgaacgtgttcaaggt

SEQ ID NO: 87308 - DNA, 808 bp, Zea mays
  misc_feature: Ceres CLONE 1574289
  misc_feature: Encodes the peptide sequence at SEQ ID NO. 87309
ctggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgcgcgcgcaaggcgggcccggcgccagggctggtgacctcagcggggccatggacttcggccgctcc

SEQ ID NO: 87309 - protein, 218 aa, Zea mays
  misc_feature: Ceres CLONE 1574289
  misc_feature (103)..(211): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRARKAGPAPGLVTSAGPWTSAA

SEQ ID NO: 87310 - DNA, 1057 bp, Zea mays
  misc_feature: Ceres CLONE 1574292
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (1057)..(1057): n is a, c, t, g, unknown, or other
agagcaccataaaaattggatcggggggttgtatggggtgtggaattgtgtgtgggaaggaannnnttgttttttttttcaaaactggagctccccgcggtggcggccgctctagaactagtggatcccccgggctgcaggaattcgtctcacccctagaaaaaccccccccgtctctctctcctcacccccctctctctctaaaagactgaaaacaatagaaaggaacaaggggggaagaacaccaaccaagcaggacttggtttttgggaactccatgggctgtggaattgtccccaggaatcccctctgggtttgacgagattcatacagatacatatatttaattttttcccctttcgtttgctcaaaaaatcaattgtacaggcgaaactgcttgtttgtgctttgtttcttccgtgtttgtttccttgggattttcctctggtccgttcttcttcacctgtggggtgggaggagcagagattatcatggcgaaagcaaggaccctgccgtcattgcgggaatcacaagtactccggctgtgggcggaatggagccaccaagataaagccgggtgctctgcaaattgcgttgtggtctccaaggatggagaaacggaaatgggtttcatttggggtaaacctacatcttcccaaatggcattcggcaaatggaaccataatttcgattgtaatgggatggaaacccccacggaacgtttaaggcccaaagccttggaaaaatgccccaccccgtaaccggttccaaaaaagttttttgaaaagtttccaccgaggaacaggaaaataaaaatacctaaaatctccccctttttattgaaattgggaagaaaattgggaaccccagttttcctcccttaagatccaggaaaatttttccccacaaaaggaatggggcggaggaatgtaattgtaccccccataggcctctatccgggttcctaatgctttccataggattcctgggcagggttattccataacctccctgtgggaaaaaattgtgtgcccccacaaaatgggttgcctcgccn

SEQ ID NO: 87311 - DNA, 831 bp, Zea mays
  misc_feature: Ceres CLONE 1574294
  misc_feature: Encodes the peptide sequence at SEQ ID NO. 87312
  misc_feature (675)..(675): n is a, c, t, g, unknown, or other
  misc_feature (679)..(679): n is a, c, t, g, unknown, or other
aaagctggagctccccgcggtggcggccgctctagaactagtggatcccccgggctgcaggaattcgtctcacccctagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaagacagcctggncgtncagtcgcgtctgctgggcaagtcccgcatcggcgacgagtcgtacatgccgcgctgcgtgttcgagcccaaagacagctgcggcaccatggaaggaggggcgcgccgaaggcgttccacggccattttcccgcgccccttgacgagcttgtt

SEQ ID NO: 87312 - protein, 211 aa, Zea mays
  misc_feature: Ceres CLONE 1574294
  misc_feature (115)..(208): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (160)..(160): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLXVQSRLLGKSRIGDESYMPRCVFEPKDSCGTMEGGARRRRSTAIFPRPLTSL

SEQ ID NO: 87313 - DNA, 837 bp, Zea mays
  misc_feature: Ceres CLONE 1574296
  misc_feature (830)..(830): n is a, c, t, g, unknown, or other
tggagctccccgcggtggcggccgctctagaactagtggatcccccgggctgcaggaattcgtctcacccctagaaaaagcctggggcattgctggatcagaccgaatcaacatccaggtctgctggaggcgccatacagtcccggatcccggcggtttacccctgcggcctccacggctctgcctcttcctccgcttctccttgccccgcgtgcgcgaccgacgccgccgcctccgccctaagagtcttcgtcggacacttcgtcaggaattcttcggggcccttcgccggcgacgagtacatccaccccttcccttcatgctatgctgaaaccaatcactgaaaccctaacttcagctatttgtattcggctcgaatctaattaccagcatgttcatgcaccatacctaccaacatcgattttgttttgcaaattttattgggtatacatgtcttttactgagtccgcgccttgactcgatttgagtctgtatttggtcttggtggctaattagccaaccacataccgcagccagaccatggcaggctggcagcaacccctgtgtggattggtcagtaagcacacctatattaactcgtgttgtgccaatcgaaggtgtcatcctgcctagtgtggttccttctctgacaccaactcacaactcggcatgaaacaactgatttttatagttttcctgtagatcaatatgaaagtgtttttcctccgcaaagggggaaaaaaataaaagatactggaaatttagcggccctgtagtgttctttccgggaaccactccaggtttggaagccctccggggcacctggcttntggccca

SEQ ID NO: 87314 - DNA, 768 bp, Zea mays
  misc_feature: Ceres CLONE 1574298
ctggagctcaccgcggtggcggccgctctagaactagtggatcccccgggctgcaggaattcgtctcacccctagaaaaaacggttctgcctcctctcaccgcgcgtccgcgtctgccgtctggcccctccgcgcccgcaatccacgcctccgccgccgcaatccgtgcccccacccgacgcaaccctcgcccattgtcccgtcccgcgatccgcgatgccctcccccacgcgcagaaactcccagtctcgccgatccctggaagcctgctcggcacccatcccccgacgtccagcgagggttttgggagcggcgactagggtttcgagaccgctgatgacgtcaccttcctcggtcgccggcaacatttgcgaccgtctgaggttccattttcagtccccgtgtgatttccccaatgtttcccttcctctgtagcctctccgacggcgccgccgccgttcgtttcctcggccgccggtgacattttgtgaatgtctgagcatcactgtcgtccgcttcgcttggatgcaccgttgtgaacatgcagatacgtggttgcgaattatgcggctagacgcgtgggggatttcaattgacgagtatgagaaacatggatggtcgattgaacaaattgctcaagagatttcaaggctaccattgcttgctcgctgcaaatactactgcaatatatttaaattgtattgtacaatgttataggaaattaacaatgcatacatgtaatttttgcaagctgttcaaccacttcat

SEQ ID NO: 87315 - DNA, 833 bp, Zea mays
  misc_feature: Ceres CLONE 1574301
  misc_feature: Encodes the peptide sequence at SEQ ID NO. 87316
tggagctcaccgcggtggcggccgctctaatactagtggatcccccgggctgcaggaattcgtctcacccctagaaaaaggaaaacagcaaatttctccggggtgactggttgattcgaatgcagccgtgccgagtccgccgcctccgcctccgccgccgccgccgccgtgaacgagagtgatgcgcctcgcgtcctatgcctttctacgccgcgccgccgccatgtcctccccctcctcctacagccgcacaggctacccccgccctcgccgcggctactcgggaaggccctcgccgccgccgccgccgccgcccccggacgcggcctccgagatcgtcagcagggattaccatctcagtgccgtgcacgccgccaacgaatccctgcgtcgtggcccccgcggcgacatccgctggcctccaccgccatacaggcaggggcctcaccctcaccaaccgcactatggctatggctatggctacggatacggatacggccaaacgtggcagccgggtccatcctatgggtttgtgccgtacaactaccgccacccgcagcagcagccgccggggcctcagtacggctacggagctccgaaccccgtacgttcacgggcaacctgcagccgcagccgcatgtgcgtggggcagcgagtccagggttccgtcctggcgcgccccagctggactcccgaggctggcagattacctcccaacggtgggcgcttttgcaaaagcaaagccgcccacattcaagctggggagggtttatttattcctttccctaccaaaataacttggggggaactattcctgggcccacggaagacac

SEQ ID NO: 87316 - protein, 217 aa, Zea mays
  misc_feature: Ceres CLONE 1574301
MRLASYAFLRRAAAMSSPSSYSRTGYPRPRRGYSGRPSPPPPPPPPDAASEIVSRDYHLSAVHAANESLRRGPRGDIRWPPPPYRQGPHPHQPHYGYGYGYGYGYGQTWQPGPSYGFVPYNYRHPQQQPPGPQYGYGAPNPVRSRATCSRSRMCVGQRVQGSVLARPSWTPEAGRLPPNGGRFCKSKAAHIQAGEGLFIPFPTKITWGELFLGPRKT

SEQ ID NO: 87317 - DNA, 714 bp, Zea mays
  misc_feature: Ceres CLONE 1574303
  misc_feature (206)..(206): n is a, c, t, g, unknown, or other
  misc_feature (207)..(207): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (335)..(335): n is a, c, t, g, unknown, or other
  misc_feature (374)..(374): n is a, c, t, g, unknown, or other
  misc_feature (382)..(382): n is a, c, t, g, unknown, or other
  misc_feature (559)..(559): n is a, c, t, g, unknown, or other
tcccgcgtggcggccgctctgactgtggatcccgggctgcggattgtctccccctagaaaaaatcccagatcaggattagccgaccacccgccgaaggccagagagaaatatctcatcttctctccaccggatcggttcaatcgagagcgagggagaaagggaggtggtgcgtcaaggggggcctaaattttggcgggttggggannaaaattgggggtggagtgcttcacccccgcccccgcttcgaagtttccccccccccccgggaccggccccccccggtcctcgcagcccctccgtcccccccccgcccttcccccnnnnnngggaagtnttgggagggtcgtcggtttttgagtaatcgacaacgtgnttgcacancctccccggaaataatagggggggcgatttttgggaggtaaaccccccccccctttggggtgggggttgccccccccccctcggccgctttttcgtccacaccccccgcccacgcatgcttcccccccccccgcccacgcaacaaaaacacgccgggccggctggcggggagcgctnaccacaccccgtctttcccacaataagagagggagggtgcggtctaattccgcgccccatccgcgcggacgccgagggccggtctacccacctctcgcaccacctcacccggccccactcggggtcaggccacctgcgttcccccgcagctgcga

SEQ ID NO: 87318 - DNA, 913 bp, Zea mays
  misc_feature: Ceres CLONE 1574304
  misc_feature: SWISSPROT Homolog: EC 3.1.3.16 Phosphoprotein phosphatase
  misc_feature (366)..(366): n is a, c, t, g, unknown, or other
  misc_feature (367)..(367): n is a, c, t, g, unknown, or other
ctccccgcggtggcggccgctctagaactagtggatcccccgggctgcaggaattcgtctcacccctagaaaaaagagagacggagaggggagacccggtcactgccaatgccaagaacaagaaaccagagaggacagtcgtcaatccaatccgagtctcctccaaaaacccatcaatctgcatgaacgagagcagcaggagagcatcctaggaaaaaagttaggaccaactgaccgagcaaaaaaggtagcatctctgtatcaccaaggcaccgccgatcacagaccaaatccctcccccctcctctggtccatcccacacgtagagcagccggtatttcttcgatccgtgcttgcgcttttggnnacactttggaaagatttcgtttccctcccttttaagtgttgtcaagaagtttcgacaagagtggtgtgagtgttgaagagctcctcaacatgatggatccggccttgcttgacgacatcatacgccggctgctggaagtgaagaaactcaagcctgggtaaaaacgcgcagttcgtaggagtcgggagatcaagcagctctggcgcatgccggccagggagatcttttgttggcaccatgcccaaaccctgcctggaaagctctgtggacgccccaattggaaaatttggcggggggatggaccctgggggccaagatacggttgaatgttcctgagaggggcttttttcaaatatagaggtgggctttgcgcggggttaagggcgagaagtaccctttttacatgggggggaaggagggaggaatatatggggaggaggaaaaggcgtgggaaaaaaattatggtccctccttttatatgctccaaaggggtggagaaccggagaaagaactctccatatggtcgctggggggggaaaccactgt

SEQ ID NO: 87319 - DNA, 999 bp, Zea mays
  misc_feature: Ceres CLONE 1574309
  misc_feature: Encodes the peptide sequence at SEQ ID NO. 87320
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
aaaaaaggaatttgtgggtacactgtgaataataaataaggaaaacaaaacaaaatttnnngntcggnnnncgcaaagctggactccccgcggtggcggccgctctagaactagtggatcccccgggctgcaggaattcgtctcacccctagaaaaaacgtccatccgtatttccgtcacaactctcaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcaaggttacccacagcagggctacccgccgcagtaagagcaacagcctccacagcaacagcagagcaccgccccccccttcatggaaggatgcttggctgccctctgctgctgctgcctcctggacgcctgcttctgacggaaccatccgtgccgggtccaacacggctgcaactgaagcaaccagcttacggaagagctggaactgggcccgttgctattctaagctttggtcctgcaattaaacgcccctctttgttctttttcttcttcattatatgtgttttcgtctcatctccatctctcactctggttaataaagtacctacccgggataacttcttgttcccaatggttcctatttgggaatttaaaaacctaaaggggccttggtaggtaataatattctgcttgggaatgagaacccgctggatttgctttgggtgggagaatttccaaggttttctaaaaaacctgaagtaaattaattggtaactgttccatctccgtcgtaaacttaactgtctcattataaaatcgttgggccgtttcatcttacacagttaagtggttctaatcccaccacaatcctcca

SEQ ID NO: 87320 - protein, 59 aa, Zea mays
  misc_feature: Ceres CLONE 1574309
MSYYGQQPPVGVPPQQGYPGKDGYPPAGYPPAGYPPPAQGYPPQGYPQQGYPQQGYPPQ

SEQ ID NO: 87321 - DNA, 843 bp, Zea mays
  misc_feature: Ceres CLONE 1574310
  misc_feature: Translation starting site: 495
ctggagctccccgcggtggcggccgctctagaactagtggatcccccgggctgcaggaattcgtctcacccctagaaaaaatgttgggtgggaggatgtgtacaaagcactgggaaacctaagaagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgaggaggaagagacggagataccctcttgcccgtcgctgccggatgcaaacgtgccaagaggtgcgcgctttgacgtcgtcgccgtgaagctcccatgcacccgtgtggcgggctggtccagagacgtcgcgccgcttcatctgcagctctcgggcagcaaactggctgtggggtcctcgaagcgcaaccacgaagtccatggtctctttcgtcactgactggtttcccgatcccggaacctcctccccttgcaagaacccttgtcacaccgtgaatggcacccccctgttttgtaaagtccctgactccccaaggggttttaagggaaaaaagtcaaggctttccaatcccgggccccgggaagccttggccgttccccctccaaagcccaatatcgaggctttttctcgggtaattccaccaaaaaagaaaccgtaccccaaagaataccggcatttcacgcagggcaaatacgttttggcgggggaaaatttcgggaagaggcaaaaagaattcgcccccgggcaggatcccacccggggaaccg

SEQ ID NO: 87322 - DNA, 880 bp, Zea mays
  misc_feature: Ceres CLONE 1574311
ctggagctccccgcggtggcggccgctctagaactagtggatcccccgggctgcaggaattcgtctcacccctagaaaaaatgttgggtgggaggatgtgtacaaagcactgggaaacctaagaagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgaggaggaagagacggagataccctcttgcccgtcgctgccggagccaaacgtgccaagaggtgcgcgctttgacgtcgtcgccgtgaagctcccatgcacccgtgtggcgggctggtcgagagacgtcgcgcggctccatctgcagctctcggcagccaaactggctgtggcgtcctcgaagcgcaaccacgacgtccatgttctcttcgtcactgactgcttcccgatcccgaacctcttcccttgcaaggaactttgtcacacgtgaaggcagcgcctgggttgtacagtcctgactccaaggcgtttgagggaaaagctcaggctttccagtcggggtcccgtgaaccttgcccgttccactcaaaaacccaaaccgagggcttttttcccggtagaatccaaccaaaaaaaaaaccgttaccccaaccaaatcccggcattttaagggaagacgaaaataaggttttggggggggggcaaaatttctggggggagggacaaagaaactaccccggccccggggggtggagagatcccccccaccgggggggaccccgggggtgaacacacccccctgtgg

SEQ ID NO: 87323 - DNA, 832 bp, Zea mays
  misc_feature: Ceres CLONE 1574312
  misc_feature: Encodes the peptide sequence at SEQ ID NO. 87324
ctggagctccccgcggtggcggccgctctagaactagtggatcccccgggctgcaggaattcgtctcacccctagaaaaaccccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaagcggagttcatcgacctggcgcgccagtcccgcaagttcgacgaagacagcctggggtttccatcgcgtccgctgggcaagttccggatcgggaacaagtcgacatgccgcgctgcgtgttcgagcccacgccagctgcgccaccatgtaagaaggccgcgccctagcgtccacggccatgttcgcggcgctggacgaactgttcaacaagtgccgg

SEQ ID NO: 87324 - protein, 213 aa, Zea mays
  misc_feature: Ceres CLONE 1574312
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARQSRKFDEDSLGFPSRPLGKFRIGNKSTCRAACSSPRQLRHHVRRPRPSVHGHVRGAGRTVQQVP

SEQ ID NO: 87325 - DNA, 900 bp, Zea mays
  misc_feature: Ceres CLONE 1574315
  misc_feature: Encodes the peptide sequence at SEQ ID NO. 87326
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (495)..(495): n is a, c, t, g, unknown, or other
  misc_feature (497)..(497): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (505)..(505): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (526)..(526): n is a, c, t, g, unknown, or other
  misc_feature (527)..(527): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (547)..(547): n is a, c, t, g, unknown, or other
  misc_feature (555)..(555): n is a, c, t, g, unknown, or other
  misc_feature (556)..(556): n is a, c, t, g, unknown, or other
  misc_feature (562)..(562): n is a, c, t, g, unknown, or other
  misc_feature (571)..(571): n is a, c, t, g, unknown, or other
  misc_feature (572)..(572): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (657)..(657): n is a, c, t, g, unknown, or other
  misc_feature (658)..(658): n is a, c, t, g, unknown, or other
  misc_feature (672)..(672): n is a, c, t, g, unknown, or other
  misc_feature (679)..(679): n is a, c, t, g, unknown, or other
  misc_feature (680)..(680): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (703)..(703): n is a, c, t, g, unknown, or other
  misc_feature (714)..(714): n is a, c, t, g, unknown, or other
  misc_feature (715)..(715): n is a, c, t, g, unknown, or other
  misc_feature (719)..(719): n is a, c, t, g, unknown, or other
  misc_feature (720)..(720): n is a, c, t, g, unknown, or other
  misc_feature (726)..(726): n is a, c, t, g, unknown, or other
  misc_feature (727)..(727): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (766)..(766): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (789)..(789): n is a, c, t, g, unknown, or other
  misc_feature (790)..(790): n is a, c, t, g, unknown, or other
  misc_feature (798)..(798): n is a, c, t, g, unknown, or other
  misc_feature (800)..(800): n is a, c, t, g, unknown, or other
  misc_feature (801)..(801): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (835)..(835): n is a, c, t, g, unknown, or other
  misc_feature (836)..(836): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (888)..(888): n is a, c, t, g, unknown, or other
  misc_feature (891)..(891): n is a, c, t, g, unknown, or other
ctggagctccccgcggtggcggccgctctagaactagtggatcccccgggctgcaggaattcgtctcacccctagaaaaaaccctctctttcgttacctacaggctacagctcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttggttcgtataatgttccccaatccccctttagttttggtgattctgcagaaaaccgttgatatctgttttttttttgggggggggggggggggggggnnnnnnnnnnnnnngnnnnnnnnnnnggnnnnnnnnnnnngnnnnggnnnnnnnnnnnnnagnnnnngnnnnnnnnnnnnngnnggggggngnggnnnngngggggggggnnnnnngggggnnggggggggggnnnnnngggngggggggnngggggnggggggggnnggggnnnnggggnnngggggggnnnnnnnnnnnggngnngggggggggggggggggggggnnnnnggnnnggggggggggggggnngggggggggggggnggggggnngggggggggggggggnnnnnggnggggggggggnngggnngggggnnggggggggggggnnnnggggggggnnnnggggggggggngnnnaaagggggggggggggggnngggggggngnngggggnnngggggggggggggggnnnnnnggggnnggggggggggggggggggggggggggggggggggnnnggggggggggggggnggnggggggggg

SEQ ID NO: 87326 - protein, 32 aa, Zea mays
  misc_feature: Ceres CLONE 1574315
MAKTSSFKLEHPLGSYNVPQSPFSFGDSAENR

SEQ ID NO: 87327 - DNA, 848 bp, Zea mays
  misc_feature: Ceres CLONE 1574316
  misc_feature: Encodes the peptide sequence at SEQ ID NO. 87328
tggagctccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaagggcggtacgagctggggcgggtgctggggcacggcaacttctggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcgagctcgtccgcggcggggagctcttctccccgcatcgcgcgcgcgggggcgggtccgggaggacctgtgcgcgctgtttacttcgggcagtctcgtcgcccccggtcgaacttctgccacgggccgcgtggggtgtttccaccgtaaaccctgaatcctcgaagaaacctggctcccttcgacgaaggtagggcaaaccctctaaagtggggccggaacttttgggggccct

SEQ ID NO: 87328 - protein, 157 aa, Zea mays
  misc_feature: Ceres CLONE 1574316
  misc_feature: SWISSPROT Homolog: EC 2.7.11.1 Non-specific serine/threonine protein kinase
MEDAMAADGKSVLQGRYELGRVLGHGNFWRVHAARDLRTGRSVAVKVVAKDKLERAGMAEQIKREIAVMKMVSHPNIVELHEVMATRSKIYLALELVRGGELFSPHRARGGGSGRTCARCLLRAVSSPPVELLPRAAWGVSTVNPESSKKPGSLRRR

SEQ ID NO: 87329 - DNA, 800 bp, Zea mays
  misc_feature: Ceres CLONE 1574318
  misc_feature: Translation starting site: 194
ggagctcaccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtgcagagtgatattaagctgtggcccttcaaagtcatgcctggggcccgggtgagaagccaatgatagttgttcagcacaagggggagagaaacagtttgcagccggagagatctcctccatgggtctcatcaagatgcgtgagatcgctgaaagcttaccttgtcagcacgatcaagaatggtggtggcacgggtccctggctaccttcaaagacttcacagaggcaagccaccaaagatgcttggggtggattgctgggcctcaaagtggctgccgttacctcaatgaccaaccgcctgctgccatttgcccaaagggcctgaacaagaaagcgaacccccggccgggg

SEQ ID NO: 87330 - DNA, 764 bp, Zea mays
  misc_feature: Ceres CLONE 1574321
  misc_feature (41)..(41): n is a, c, t, g, unknown, or other
aaagctggagctccccgacaggtggcggccgctctagaacntagtggatttcccccgggctgcaggaattcgtctccccctagaaaaaccccccttcccctctctcgcccctcctccctccgtctcgtctcccaggtcatggcaaaagctggagcaccgggaaaaatagcaagtgggaaataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgttgtgtttccctggcgtccacaacttcgtgggatctcctgcagccaaaccggcggacaagaacttgggctttcccctcactcatggccgaaaaacgtcttccgggcgacccattccttaatgggggaaaggtaaattttgttgagaccccccgccagaaaaattttccccggaaccccggggaaagaaacaaaccccataatccaccttttaaggaaattccgagaaaccgggaggcccccccctttttgggcgcccccccccctttaaaactttaaaaacggcccctcgggggaaattctcccacaaaaaaacccccggcaaaaagaaaacccccttggttttaaggggggggggggggggcctttatcccaaaaaggagtttttattcataaaaaaa

SEQ ID NO: 87331 - DNA, 970 bp, Zea mays
  misc_feature: Ceres CLONE 1574327
  misc_feature (69)..(69): n is a, c, t, g, unknown, or other
  misc_feature (586)..(586): n is a, c, t, g, unknown, or other
aaacaaaacacaacaaacaccaaccccaacaaaacacaacccaacaaaccaaaacaaaacaaaaaaacncaccaactgactcccgcgtggcgccctctgactatggtccccgggctgcagaattcgtctcacccctagaaaaagtctcatatctacctcgaaagaggggtccatacgaacccttccaccctcccgacccaccttcgattcctctgcgatttccccccgcgcgctcgccattccttgatcgactcccgcgtgattcgctttctggtcggatctctctcctcaagcatgcagtcggatcagctgtgatcacttgcccccggcggcggcaggcggccgcgcgcccggcgcctcttctcccccgccttttccacctccgttttcggaaaacttcctcccccctgcacctcggtggccccctcccggatcttccaaaaatgggggatttcacatttctccccccccccccaacccccgttcccttttcccccggaaaatcccccccccccccaactcccctaaaaaccctcccatcaaaaggcgccctcaaagaaaaccttttctaaacgggcctcccccnccaacaacaaatctctcaccttcaacggctcttttccttggcggggggaaacaatactccgaaaaccccctcgcgtttttttcccccaatggtaatttctcccccccttttttttcaagggggaaaaaaaattccccaaggggggttcaaaaaccccaaggggcgcccaaaaaatccccgctttttttctttgtataaaggcggaaaatatacccccgtattatttgggggggggccaacgggcttttaaaataaaccccccctttcgggggttttttgaatgaaaagaaatttcttggtgggaaaaaaatttggcccccccgcgctaaaagaaaaaccccccccccccccccctctggtgggggggcgcacaaaaaaaaaaaa

SEQ ID NO: 87332 - DNA, 832 bp, Zea mays
  misc_feature: Ceres CLONE 1574331
  misc_feature: Encodes the peptide sequence at SEQ ID NO. 87333
ctccccgcggtggcggccgctctagaactagtggatcccccgggctgcaggaattcgtctcacccctagaaaaaacaccaccaccggtcaccgaaacgcagcatctgacaggcacctgacggagagctagccgctctgcagccgagtcgagtcgaactagcgcgcgagcgagcgaggaagaagaagagctagctatactgctgcttcctcgcgcgcagcagcagcagcaaacgaagaaagctccatctgcttgcgcacacacacacatacacacacacaccagctagctccatgggcggcagcgcggatgcgaacggcgcggggtcggtgcgggtgccggtgccgccggcgcggccgttcctggacacgttccgcgggaacctcaaggagaccttcttcccggacgacccgttccacggggtggtgcgggagcgcggggccgggcggcggaccgtggccgcgctgcgctacttcttcccgttcctcgagtgggcgccggcctacgcgctgtccaccttcaagtccgacctcatcgccggcatcaccatcgccagcctcgccatcccgcagggcatcagctacgccaagctcgccaacctgccgcccgtgctcggactctactcgagcttcgtgccgccgctggtgtacgcgctgatggggagctccaaggacctggcgtggggaaacgtggggccggtgggcgtgacccacgcttaccgcctctgcgcggaaggtctcgcatccatggaccgtttaactcccaagcgggtaagcggcaaatggtacggtgaacatcccacgattggccggggttcggtcataacccgcccca

SEQ ID NO: 87333 - protein, 180 aa, Zea mays
  misc_feature: Ceres CLONE 1574331
MGGSADANGAGSVRVPVPPARPFLDTFRGNLKETFFPDDPFHGVVRERGAGRRTVAALRYFFPFLEWAPAYALSTFKSDLIAGITIASLAIPQGISYAKLANLPPVLGLYSSFVPPLVYALMGSSKDLAWGNVGPVGVTHAYRLCAEGLASMDRLTPKRVSGKWYGEHPTIGRGSVITRP

SEQ ID NO: 87334 - DNA, 865 bp, Zea mays
  misc_feature: Ceres CLONE 1574335
ctggagctccccgcggtggcggccgctctagaactagtggatcccccgggctgcaggaattcgtctcacccctagaaaaaagaaagaggttccactctgtctgttccctccttcctgctgttacaatagattgttactattagccagtctgagtaatacatgtgacatttgggattgtccttgttcaccaatagctaatagctgttaacatctaaaaccagccatccgtcttctgggaagaagatgtatagtctcccgatcctagttctgcctctccagatgcatccttcgtcactcactctccctacatcctgtcactagactggtgttaaaacctgatcagacctttactcccatgattcacatgtctttgcagacgtccatatcgatatgctacttcttggaatccacgctttgtgttatactggtgcttaatgaccgtgatcgacaatgccgcagcttttacacagtaagttccaacctattcttacttgagcataaacatatatcctgcgttgctccttatctgactcgttccatcgctgtgaagagggtcacgacagaatatgggccgtcttgtagcgtcccagtccatcacgtgttctgcatataatgcaatagcataccccaatctgttctcgttaccgagcatgctcattgcatccccctgcatacaaaggatctggcatgcaaccttcctcagcttcagagaagtggaccttacattggtgacttgccatccatcatgtcgcactcgggatggagggggtgcgacttacctcatacaggactcagatttctaaagaaattcccgagttggagcactaggatgtggagaaagaggcacctgcgcttcatcatcatt

SEQ ID NO: 87335 - DNA, 795 bp, Zea mays
  misc_feature: Ceres CLONE 1574337
  misc_feature: Encodes the peptide sequence at SEQ ID NO. 87336
tggagctccccgcggtggcggccgctctagaactagtggatcccccgggctgcaggaattcgtctcacccctagaaaaaaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagccccgagagctagagctgcaaacgggagatccccgtgagggagagatcacggaggcggtggcccgtagctgtaggggggaccccggtcaaaaatccccctgggccaggggggaagaaagccccaaaaaaaaccccccttttggctttcccctttccagaagtcccaaggggggcacccccccctttttttaaggagggggggggggaggaacccccccggggggttttttctttttccccccccccccgggggggggaggggggcccctccttcttccaaaaagaaaaaccccccccctt

SEQ ID NO: 87336 - protein, 175 aa, Zea mays
  misc_feature: Ceres CLONE 1574337
MGRRRRFAQLDDDDDDDEDVPINFKPSGGASSSDAKPRKPQPPPQQRRGVSDDDDEDVEEVELEEEEDDEKDLEAMRRAEEEERREQEAETKTRRRRGRPKRRRDPGSEDEEPRELELQTGDPREGEITEAVARSCRGDPGQKSPWARGEESPKKNPPFGFPLSRSPKGGTPPFF

SEQ ID NO: 87337 - DNA, 2025 bp, Zea mays
  misc_feature: Ceres CLONE 1574338
  misc_feature: Encodes the peptide sequence at SEQ ID NO. 87338
aatcacatctgcacacctctccgcccctctcatcagtcgcatgcatatgtaagccgcagcaacacctatcgaagccgcagcagcaggaggaggcaagggaatcccaagcggaagggtctcctcgctctcctatctcccttccatcagctgcggcgggcggcgatgggggcgcggaggaggctgctggcggacacgccgccgccgccggagcatcgccacaggcagggcgcgccggcgtcggactggagcgaggggtacctcaacgggtggctgtcgcagccgacgccgatcttcggcctccgcctctgggttctcgtcggcatcgccgtcggcgccgccatcgtgctcgtgctcctcctcatcttcgtctgcctctcccaccgccgccgccgccgcggcggcgacctgctcgccgccaacctctaccccgccgccgacaccaagctgctcaagcagcacctccagcaccaggccacgcccaccaaggacatccaggagattgtccgccgccagcaggcggagacgccgcctccgccggcggtgcagctcgccaaggccgtggcggagccgaagacgcctcctccgccgccgccgcagcagcacaggcagccggcgcggaagacgcccggcagcggcgccacgaccagcggcgggagcgaacgggacggggccacgcctaggagcacgggaagcgcggggatgcccgaggtttcgcatctcgggtggggccactggttcacgctccgtgagctggaggaggccaccgacggcctcaccgaggagaatgtcatcggggagggtggctacgggatcgtgtacaagggcatgctgcacgactccactttgatcgccgtcaagaatctcctcaataataggggccaggccgagaaggagttcaaggtggaggtcgaagcaattggtcgtgttcggcacaaaaatctcgtcaggttgcttggctactgcgtagaaggtgcttacaggatgcttgtgtacgagtatgtggacaatggtaatcttgaccagtggcttcatggtgatgttggagaagtaagcccactaacatgggacgtcaggatgaacattatgcttggaaccgccaaagggttggcttatcttcacgaggggctggaaccgaaggttgttcaccgtgacatcaaagctagcaacattcttcttgaccagcagtggaacgctagagtatcagattttgggcttgcaaagctattgtggtcagagaaaagctatgttacaacccgtgttatgggaacctttggttacgtggcgcctgaatatgccagcaccggaatgctgaacgagaggagtgacgtatatagctttggcgtactcataatggagatcatcactggtagatctcctgtagactacacaagagcagctggagaggtcaacttggttgagtggctcaagaccatggttgccgagaggaaagcggaggaagtagtcgacccaaagatggctgaaaagccatctcccaaaacgctgaagcgggcgctcctggtcgcgcttcgctgcgtcgaccctgatgcgaacaagaggcctaaaatggggcatgtgattcacatgctcgagatggacgatctcctcttccgagatgataagaagcccgggagagacgttcatccccatggttcagacagatacagctccaaggaggaagggagcatcagcaagcgcgaacaccaccaccaccaccaccatcggcacagatgatacacagcaagcgcgagcatctgaggattgccattagagagtagcgacattaaccatgttccccgcttctttcccctcccgttcaatctcactggtctttgattgtattatatgtgagcatccatcattctgtgacgatacttgatacttcaatcgcacacacagacacacaatgacacgcaagtgtagggggaaaaaataggcatggtgtttgtgactgactaacatgcccagaccaggccaaaaacctgcagatgttcaatgcaaggattccagcaaaaaaaaaaaaaaaaa

SEQ ID NO: 87338 - protein, 522 aa, Zea mays
  misc_feature: Ceres CLONE 1574338
  misc_feature (204)..(475): Pfam Name: Pkinase_Tyr Pfam Description: Protein tyrosine kinase
  misc_feature: SWISSPROT Homolog: EC 2.7.11.1 Non-specific serine/threonine protein kinase
MGARRRLLADTPPPPEHRHRQGAPASDWSEGYLNGWLSQPTPIFGLRLWVLVGIAVGAAIVLVLLLIFVCLSHRRRRRGGDLLAANLYPAADTKLLKQHLQHQATPTKDIQEIVRRQQAETPPPPAVQLAKAVAEPKTPPPPPPQQHRQPARKTPGSGATTSGGSERDGATPRSTGSAGMPEVSHLGWGHWFTLRELEEATDGLTEENVIGEGGYGIVYKGMLHDSTLIAVKNLLNNRGQAEKEFKVEVEAIGRVRHKNLVRLLGYCVEGAYRMLVYEYVDNGNLDQWLHGDVGEVSPLTWDVRMNIMLGTAKGLAYLHEGLEPKVVHRDIKASNILLDQQWNARVSDFGLAKLLWSEKSYVTTRVMGTFGYVAPEYASTGMLNERSDVYSFGVLIMEIITGRSPVDYTRAAGEVNLVEWLKTMVAERKAEEVVDPKMAEKPSPKTLKRALLVALRCVDPDANKRPKMGHVIHMLEMDDLLFRDDKKPGRDVHPHGSDRYSSKEEGSISKREHHHHHHHRHR

SEQ ID NO: 87339 - DNA, 777 bp, Zea mays
  misc_feature: Ceres CLONE 1574339
  misc_feature: Encodes the peptide sequence at SEQ ID NO. 87340
gcggtggcggccgctctagaactagtggatcccccgggctgcaggaattcgtctcacccctagaaaaattgcattgcagttgcaggttgcacagccgcggaagccagcacctcagagccatggcgtaagtggaccacctcgctgccgagagggccaccgcgcgcttctacgtcgaggagatgaaggttgcgtgggccggctcacgccacgccgtccacgtcgccgaccgcatggcgcgcctcgtcgcatccgaccctgtcttccgcaaggataacaggaccatgctctccaggaaggagttgttcaaggacactctaagaaaagcagcgcatgcgtggaagcggattgtcgagctacgtcttacagaagaggaagcggatttgctgacaccacctgttgaccagcctggttatgttgatctgcattggggcatgttcgttcctgctatcaaaggccaaggaactgaggagcagcagctcaagtggttaccactggcttacaagttccaaataattgggtgctatgctcagacggaacttggtcatggctcaaacgttcagggcctagaaacaactgctacattcgatccgaagactgatgagtttgtcatccacagtccaactctcacgtccagcaaatggaggcctggtggcttggggaaagcttccacccatgcagtggtgtacactcggttgataactgaaggaaaggactttggcatacatggtttcattgtggcacctgccaagctttaaggatcactccccactttcccga

SEQ ID NO: 87340 - protein, 191 aa, Zea mays
  misc_feature: Ceres CLONE 1574339
  misc_feature (114)..(174): Pfam Name: Acyl-CoA_dh_M Pfam Description: Acyl-CoA dehydrogenase, middle domain
  misc_feature: SWISSPROT Homolog: EC 1.3.3.6 Acyl-CoA oxidase
MKVAWAGSRHAVHVADRMARLVASDPVFRKDNRTMLSRKELFKDTLRKAAHAWKRIVELRLTEEEADLLTPPVDQPGYVDLHWGMFVPAIKGQGTEEQQLKWLPLAYKFQIIGCYAQTELGHGSNVQGLETTATFDPKTDEFVIHSPTLTSSKWRPGGLGKASTHAVVYTRLITEGKDFGIHGFIVAPAKL

SEQ ID NO: 87341 - DNA, 863 bp, Zea mays
  misc_feature: Ceres CLONE 1574340
  misc_feature: Encodes the peptide sequence at SEQ ID NO. 87342
atagctggagctccccgcggtggcggccgctctagaactagtggatcccccgggctgcaggaattcgtctcacccctagaaaaaccctttttccccttcacagccccgtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaacacggatctgctgcagaagttgtcgctggattcccagccaaagcgggcggtgcgacagaccctgctgctgctgccgctgccgccaaagaaggtgctgttgaaaaccaagccgctgaatgtgccatccccgcaaaaggggctatcacgcccgggcctcaggaatttatggatcccaaccgggttcattctccaagggttttactatggggggcacaaaaagttcccttgaggggggggggaagatttccccaaaaatccaaattccaaagggggggggaaattggccccccccggggggggggaaaattttgggggaaatgggggttaccccccccaagggggggaaaaaacttgggggggagattttccccagatttaaaaggggtgtgtgggg

SEQ ID NO: 87342 - protein, 112 aa, Zea mays
  misc_feature: Ceres CLONE 1574340
MAAVATPPAPAPAAPAPAPAPAAAPAPVTVAPAADQNTDLLQKLSLDSQPKRAVRQTLLLLPLPPKKVLLKTKPLNVPSPQKGLSRPGLRNLWIPTGFILQGFYYGGHKKFP

SEQ ID NO: 87343 - DNA, 1231 bp, Zea mays
  misc_feature: Ceres CLONE 1574341
  misc_feature (1)..(1): n is a, c, t, g, unknown, or other
  misc_feature (61)..(61): n is a, c, t, g, unknown, or other
  misc_feature (819)..(819): n is a, c, t, g, unknown, or other
  misc_feature (1189)..(1189): n is a, c, t, g, unknown, or other
naactttaagaatttgggtaggttttgggggtacctacgccggtttggctgttggggggtntataatttttgcaaactggagctccccgcggtggcggccgctctagaactagtggatcccccgggctgcaggaattcgtctcacccctagaaaaaccctttgtccccttcacagccccgtactactatccccgctaccgccagccgccgcgctgctcatctggtggcagctcgcctccctccccccgtccgccgccgcgggatcctcctctaggtccttccttacccccagctttaatctcgtgctacctgcctacctatccgtagggagacagagagagaggggataacgttcggtagatcgtgtcgggagttattatatataccttctggctcccggtttcatctttgggatcagtctcggggcgggcaatgtacacccacccgagccaccacccgcccccactcccatcggacattgccccaacacctagcacctgctggttggtctgtgctgcatgtcaaaaggccgccccctgactcaaagtatacaaaccacgcgattcttatctgaaacaatttggaccgcttgggaatctcgaactcctatatgctatgaaagttgtatggaacgctcagcctgggcttgatatctttggtcagcctagaacctcgtcatttggcttggcgaggcccttgttatacccttcttccggtgggcctactctatccaatagacgactgttccgtctctaccccactaataatgtaaagctgtgcatgaataaaggggaatcgaaccctacatatcgctatctntcatctaacatcaagccgtccataaatctccaatgtgcgtcctcaacagcgacgatgtgggacgaacattgttccacaaatcgccatctactggtgtatagttaatatcataataaatatatggaatgcattacgaaccactgggcgattcgacagtcgaaaaaccatattggtatagtcaataaaaacacatctccccgcccctctacagtccgtcgcacccgtgttttctatagcgagtgttggtggtgacaacggggcagaatccattttacataagactctgcatcaaaacccttctcttacagaagaatgaataagtagaatggtcctttccctctaatgataggttgtcaaatcaacgcataanaaagagtcttatcatcggagttggtccgcctggggagccagg

SEQ ID NO: 87344 - DNA, 897 bp, Zea mays
  misc_feature: Ceres CLONE 1574342
ggagctccccgcggtggcggccgctctagaactagtggatcccccgggctgcaggaattcgtctcacccctagaaaaatagaaacattattcgcgacctagatggtttttcccaagataaggattaggacacacactctacagagatagagagagaggtggtggccggtggtacgtccgtggtggtggttgacttagatcggttgttcttgttactcggtcctcgctggttctgacgaggtcatgatcaactgatgcctattgattggttatggacttgcacctgttgttcgagaacagattaactggtgcttacgtctactaggagtttcctatggaaaacaacttatcgaagactccttggccaggtagtcgactcaagtctgagttcacgatttcaccacaccctcatcgtttcctcccagcttcaccgtgataattatgtctgcactcatcaaaagtccagataaccagagctccacagaaactatttccgcacaatcaatatcacctctggaagtagatcgctcctacaaaccaggcagctactacttcgggacaacaaccctagtgacacctgatccattgtacacggcatcaacgcataatacggaacccccttttccattaaaaaaggtcttgtctctcatgcgaccatgactgctcattaagactgcctactaaccacccctcggtgaatttgcaaggaacccaaaaacctgccttcaaactgattcgatgccatccgggatccaaaggacatgggagattcatgcaaatcctaaggcccgcccattgcacccaagaagtttgttcccggcacacccaacttggcattcttgccatttccctcacacaggccaacgcttgagtggagctaacccggcaccatccaaaa

SEQ ID NO: 87345 - DNA, 936 bp, Zea mays
  misc_feature: Ceres CLONE 1574349
  misc_feature: Encodes the peptide sequence at SEQ ID NO. 87346
  misc_feature (581)..(581): n is a, c, t, g, unknown, or other
  misc_feature (865)..(865): n is a, c, t, g, unknown, or other
  misc_feature (878)..(878): n is a, c, t, g, unknown, or other
  misc_feature (932)..(932): n is a, c, t, g, unknown, or other
ctccccgcggtggcggccgctctagaactagtggatcccccgggctgcaggaattcgtctcacccctagaaaaatcgccaactcggagaccttgagaggaaagccaccgcgcgctagggcctagggcagggcacgagcaaaggccctcccgcgggttccattggagcgcgagcgaacggcgccgacgcggcaacacacattcgctttatttgccatgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgtgcaagacgcacaatgtcatcacggtgaacgggcaggtacctggggcccaccctggaggtcaggaaggggcgaccacgctgggtgatcaacgttcgtcaaccggggcgcagtacacacttcacccatccacttggcacggccatcccggccaaatgaaggaaccggggtggggccggaacagggcccggaaatttccgtaaaccgcaagtggccccccattcaagggccccggangggccaagtcttaccaaattaacccgggtttccaccccattccgaagggggagcctgggaaaggggcaaccccctttattgagtgagacaacccccacaaaccaagcttccctggggcctccagggggcaaacccggttcttaccaggtggcggcctttaatttattctcccccccccaggtgggaaaaacacaaaaaacccttaccccccttttcgcccaatagcccccctccgcggaaaaaatccccccgccccataccttgggggagaaagggggcggaanaccccaaaaaccncaatatcaaacgctcctccccggagaaggcccccaaaagaaaagcgcggggccncccc

SEQ ID NO: 87346 - protein, 110 aa, Zea mays
  misc_feature: Ceres CLONE 1574349
  misc_feature: SWISSPROT Homolog: EC 1.10.3.2 Laccase
MTSPSSSSSWLLLLLSCLALALLAADAEVHHHEFVVQETPVKRLCKTHNVITVNGQVPGAHPGGQEGATTLGDQRSSTGAQYTLHPSTWHGHPGQMKEPGWGRNRARKFP

SEQ ID NO: 87347 - DNA, 1333 bp, Zea mays
  misc_feature: Ceres CLONE 1574350
  misc_feature: Encodes the peptide sequence at SEQ ID NO. 87348
  misc_feature (23)..(23): n is a, c, t, g, unknown, or other
  misc_feature (24)..(24): n is a, c, t, g, unknown, or other
  misc_feature (116)..(116): n is a, c, t, g, unknown, or other
  misc_feature (118)..(118): n is a, c, t, g, unknown, or other
  misc_feature (123)..(123): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (824)..(824): n is a, c, t, g, unknown, or other
  misc_feature (1227)..(1227): n is a, c, t, g, unknown, or other
caaacacacacagtacagacagnnagaaaaacaaaaaaaaaaagaaaaaaaaaaaaacacagaaaaagaaggaagggagggataactaccaagagaagaagggagaatttaattananagatngnnnnnctaaaactggagctccccgcggtggcggccgctctagaactagtggatcccccgggctgcaggaattcgtctcacccctagaaaaaaagaacagcctcaggttactcgcagaaaagatttattagctcgccgcgggggtcgaaccgagactcctagctagctgatcgcgcgcgcacaaggcgagcggacaagaaagcttgctttgtgctcaccggagggaggcggaacaaaccccctgcaatggaagccgtcggcatcactcctgcccccttggcggcgccagagaaaaaaaagctgcttgacctcaaggaccacttccccgccgccgcgaacggcggcaccaaggcgtacccggccagtaaattggccatcaaaaaaaaattggtggagtagaaaaaaccgctgcgcccccccacgaagtaacggaacctcaacggaatacaaagcgccaaactccccgacatacccccgaaatcctcctccaaagacaaaaccccgggactaatttcaagttcttccaaaaaaaaagaattttctgtgcaaaacccccataaaaaaaaaaccctgtcaaacgccaaaaaaaaaaattgggcatggatgccccactataaaaaaacccacggtgggcccaaaaggggggggcaaaccccaaaaactctttttcccggaacacactaagaacacaaggagggacnacacaccccgtgcatacaaacgaccggggggaggaggagaactcactcaattaacaccaaaaaagagaccccccccggtaattagttttaaaaagaggaggggatggtaaaaaaaaaaatggacgttcccacgcgaacccgccccaataatatttaggggagtattgaacaacaccccctttggtagtaggggcatgacaaaaggggaaccccccccacccgttaggaggcaccccccccaggggggggggagatttctgcttggaagaaaaaccaacacgcgggggtgtcgacaataaatcgccctcagcaccgcaaaaaagacgccactcctgtcggctatttaaagccgcgcggcgccctctttggggcactaaatgggagagtaagtaagtggtttagnaagggaggggcacaacgctcgtctccccacaatgaaacaaagcttatcatatcagcgggcgctatcttttgtttaaagggggggggggggaggataaagcaatata

SEQ ID NO: 87348 - protein, 50 aa, Zea mays
  misc_feature: Ceres CLONE 1574350
MEAVGITPAPLAAPEKKKLLDLKDHFPAAANGGTKAYPASKLAIKKKLVE

SEQ ID NO: 87349 - DNA, 834 bp, Zea mays
  misc_feature: Ceres CLONE 1574352
  misc_feature: Encodes the peptide sequence at SEQ ID NO. 87350
aaagctggagctccccgcggtggcggccgctctagaactagtggatcccccgggctgcaggaattcgtctcacccctagaaaaaagtatcgcctttgcccgcacacgcggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcggggcagaggacgccggagccgccagggaaggtgaggaggcggccaagaaggacggcaagaagcggtccatcgccaagctgctcacctcgctggcggcgctggaggcggaggagcacgccgacagcgcgggcgccgcggacgcgtccaggcgggagctggcgctgctcgagtccaacgccgacacccgctcgcaggccaccatggactactacgccaagatggagagcagcttcgacgccaccgccgagtccgaggaccgcgtcaggtactagcgctccaggtctcgccgcgtagggcgccaccgaggtcgtcgtggccggg

SEQ ID NO: 87350 - protein, 100 aa, Zea mays
  misc_feature: Ceres CLONE 1574352
MTNGRRRKQRGAEDAGAAREGEEAAKKDGKKRSIAKLLTSLAALEAEEHADSAGAADASRRELALLESNADTRSQATMDYYAKMESSFDATAESEDRVRY

SEQ ID NO: 87351 - DNA, 891 bp, Zea mays
  misc_feature: Ceres CLONE 1574353
  misc_feature: Encodes the peptide sequence at SEQ ID NO. 87352
tccccgcggtggcggccgctctagaactagtggatcccccgggctgcaggaattcgtctcacccctagaaaaagacgtgcgcgtgccgctgtgctgcactgctagtgttcctgcgcgccgtgctgtccggtccgcccgcgccgcgcaccgatgccgccaccgtcttactcgcgctactccccgggccggctgctcgccgcgcgcccggcgtccgccaccacggtggggagatgggcgcgcctgtcgtgctcgctctccatgaacgggtgcgcgccgggcgccggggaccgcggcccggtgtgcgtgcgcgagacgcgggcgctgccggccgcgccggcgccgcacgacgccgtatggcggctcaaggccgccgtggacgcgctctggtccgacacaccgccgccggccgcgccctccggcatcatccgcatcgaggtgcccatcacgcagcgggtggacgccgtggagtggttgcacactcagaccacgctgccccgctgcttcttctcggcacggggcgccgttgcccgactcgcccgccctcgccggcaacgggcaacgggcaacgggcagttggcccaacggggagcagccgggtgagcctcgccgggcagtggggcttcggccggtctttcttccagaggggacggaaacccctttttcttcctcgctgaatgggcggcgcaatcccaagagattttctttccaaagggacttggtccacggggttccgcgccttatagggaccatgtccgttttcgaactcccccgaatagaaactctttccgttttaaatgggagaggacaacagggctcaagtcaaatgtcaggagggggcccccaaaacctcgggtttcatagaagatcccggtggagaagcatcaattccct

SEQ ID NO: 87352 - protein, 149 aa, Zea mays
  misc_feature: Ceres CLONE 1574353
  misc_feature: SWISSPROT Homolog: EC 5.4.4.2 Isochorismate synthase
MPPPSYSRYSPGRLLAARPASATTVGRWARLSCSLSMNGCAPGAGDRGPVCVRETRALPAAPAPHDAVWRLKAAVDALWSDTPPPAAPSGIIRIEVPITQRVDAVEWLHTQTTLPRCFFSARGAVARLARPRRQRATGNGQLAQRGAAG

SEQ ID NO: 87353 - DNA, 837 bp, Zea mays
  misc_feature: Ceres CLONE 1574356
  misc_feature: Encodes the peptide sequence at SEQ ID NO. 87354
ctggagctccccgcggtggcggccgctctagaactagtggatcccccgggctgcaggaattcgtctcacccctagaaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctaggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcgaagaagtacagcccggtgcccaggaaccagctgctgaga

SEQ ID NO: 87354 - protein, 226 aa, Zea mays
  misc_feature: Ceres CLONE 1574356
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSKKYSPVPRNQLLR

SEQ ID NO: 87355 - DNA, 988 bp, Zea mays
  misc_feature: Ceres CLONE 1574358
ccccgcggtggcggccgctctagaactagtggatcccccgggctgcaggaattcgtctcacccctagaaaaaatcgccaccgtaccggagggggctgcgcccattcaaggtgtacgggtagggtgggcgagcctgctcttcctgtctgggagagagaccgaagaagaggagagagaggcgcagcgctgcgcaggcgcgcatctcccccctccccttgccggctggcccctgctgcagctctgctccggtctgctctgcccccccgctctgctgactgctctgccgctgctgctgtctcaagcgcgccaccaaaccgccgatgcgcgcgtagcggcgtatgttccatcgtcatccatccccgcgacaacccaccacccacccatgcagtctgcagcatccccttccccactccccggtggccctgctgagggcaacccctgccgccgatccaccttccggctgcttcctgggcgcaattattttcgcccggcctcgttcgccctccggacccccggctgcgtaagggccctttccagaaaacccctcccgaaccccctcaaccttcgggctcccgacccccggggcccatttttgcactggttccccgggggcccgagaccctatcttcccgtttgtggcccggtccggttcgaaggagcccccccgttctgggtccgaaacatggggcccgagggccccgccccggttttgccatggtaaggataggtgacccggggagaatctggggctctctggggaccatctgggagaccgttatcgccctgagggtgtaaccaccttgaaatcatgggggaatttggggaagtaacactgcatgtccgcgaaagtggtgtaaccccccctgggggcctcaagggtatcttctgttactatggcccaacccatatgtgtttttgtcccaattcttggtcttttatgtatggcgggattgattttttttggccggggaagaggtttatcggtgttt

SEQ ID NO: 87356 - DNA, 817 bp, Zea mays
  misc_feature: Ceres CLONE 1574364
  misc_feature: Encodes the peptide sequence at SEQ ID NO. 87357
aaagctggagctccccgcggtggcggccgctctagaactagtggatcccccgggctgcaggaattcgtctcacccctagaaaaagcgatccagatccaggtacgtcttcctccagccccgcgatttcacctccacccccgcttctcctgcggcaatccatcgctcgcgtcgtccctactgggtgacaagagggcgaccacgcccacctccacactcttcgacctgtccccagcctgccgctgcattttctctatcttccgtccggctatttttttgctgaatggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttggatatctctggaaagtttctattatccagtgagagaacctatccagaggagatgatccaaactgggatatccaccattgatgtgatgaactccattgctcgtgggcaaaaatccccctattttctgctgctggactcccctcacatgaa

SEQ ID NO: 87357 - protein, 174 aa, Zea mays
  misc_feature: Ceres CLONE 1574364
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGKFLLSSERTYPEEMIQTGISTIDVMNSIARGQKSPYFLLLDSPHM

SEQ ID NO: 87358 - DNA, 836 bp, Zea mays
  misc_feature: Ceres CLONE 1574366
  misc_feature: Translation starting site: 313
  misc_feature: SWISSPROT Homolog: EC 4.1.1.50 Adenosylmethionine decarboxylase
tggagctccccgcggtggcggccgctctagaactagtggatcccccgggctgcaggaattcgtctcacccctagaaaaaatgacactgcgccaccgagtggttcggtaggaaaggaaatggattcccccgcatccgatctctgcggtgctagagaaatataagccgccgcctcctcctcattcggtgaaaggtgggcggttagggttgggagatctcttgactcacgacacgagcagcagaattcatggagggccgctggttgctgcgagatgtccgggccttcgtggagatcttgaaaattgaatgttctaatggagtccatgggtggcaagaagaagtctagcgatgggcgttcctccctgatgtacgaagctccccttggctacagcatcgatgatatccgccctgcatgcggcatcgagaaattctccgctgcttactcaaactgcgcgaggaagccatcctgatatctctgtcatcatccccatcctagtagcgtaaaaaccacctgcattttcattttgatctccctaatccctccggataactgctttccagtgacctaaagatatctaagaccacttcccgtcatcatcccgtggctgtctgtcatctggctctgacacgatggcagtcctgcgagttgctgctggtgctcctccccctgtctctgtgattgggtacgaaggatttgagaagcgccctgagatcagcctctctgaagcacctgtactgagtgaccccagctagaacgagacttgcttgcgctcttcacgtgcccagattcgaccctgcttctttgaccttgaatcaggggcacacattgagatcccat

SEQ ID NO: 87359 - DNA, 841 bp, Zea mays
  misc_feature: Ceres CLONE 1574367
  misc_feature: Encodes the peptide sequence at SEQ ID NO. 87360
tggagctccccgcggtggcggccgctctagaactagtggatcccccgggctgcaggaattcgtctcacccctagaaaaaatcacaggcaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctccaactgagccggcccgcccggcccggcgatggcgcacgagagtcgagaggacgacgacgacgaggcgtataaatataatagcagcgtctaaataagatcctgtcaactgcacccgccattatcgatccatggtcgctcctggggttcatgttcatctgtgtaacgtgctcgcggtcatgtccgtctcgtgcccggaattatatttatatgcatgtatttgtgtttttctggcctaatacatgtgcccgtttccttgggtggtcttccaaaaaaaaagaaaaaaaaaaaaaaatcaaccctcctccaacctctccacaaaggaaggaaccgaaccgggacgggttgtttgcccaaaaaaccaaaattgggcttttcccccccccaaaaaagtgcctccccccccccctcggattcccccttggggggtttgaaaaggagaaatc

SEQ ID NO: 87360 - protein, 80 aa, Zea mays
  misc_feature: Ceres CLONE 1574367
  misc_feature (1)..(68): Pfam Name: Metallothio_2 Pfam Description: Metallothionein
MSCSSGKCNCGSSCSCGSSCNCMSPDVETAAASSIKTMVLAAPTTKASAGGFEAATEGGGCDCNTCNCGTSCGCSCCSSN

SEQ ID NO: 87361 - DNA, 826 bp, Zea mays
  misc_feature: Ceres CLONE 1574368
  misc_feature: Encodes the peptide sequence at SEQ ID NO. 87362
  misc_feature (606)..(606): n is a, c, t, g, unknown, or other
  misc_feature (716)..(716): n is a, c, t, g, unknown, or other
gctggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctncaggtgtccaaggcggagttcatcgacctggcgcgcaagtcccggcagttcgacgaggacagcctgggcgttccagtcgcgtctgctggccaagtcccgcatcggcgacnaagtcgtcatggccgcgctgcgtgttcaagcccaaggcaggtgggccaacatgaaagaagggccccgcccaaggcttccacgggccttggttcccggccctgagacaacc

SEQ ID NO: 87362 - protein, 207 aa, Zea mays
  misc_feature: Ceres CLONE 1574368
  misc_feature: SWISSPROT Homolog: EC 2.3.1.119 Icosanoyl-CoA synthase
  misc_feature (174)..(174): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELQVSKAEFIDLARKSRQFDEDSLGVPVASAGQVPHRRXSRHGRAACSSPRQVGQHERRAPPKASTGLGSRP

SEQ ID NO: 87363 - DNA, 812 bp, Zea mays
  misc_feature: Ceres CLONE 1574369
gagctcaccgcggtggcggccgctctggaactagtggatcccccgaggctgcacgaattcgtctcaccgcctagaaaaaaccgactcgcgagtgaacgatgattggtcgcagagctctctggttgtctcggttttcagaatctcacggttccatattcaatgtctttcttctgccgtgtctgtcccatactttaagtttaccccttatctatgtggttctactccttcaatgacatccctggacgcctgtcacttatggccggatgagggtgctctatatccccgtcctctaagattccgcaaggcagctcccactatgacatgggctgggacttcatgacccccccgttgcgattcatcttctctatctccccttgccgtcacctttcagatacgacaagagagctcggactaatgacgaagattccgcacatgacatcctcgccgacgaggaccatctcatccccaagggtctccgggtgttccctactagtagcaccgttgatgccaacaacttctgcaaccagacaaacgatatgtgataggcgctcttcccgggatatcccgtaggagcgtgacccccgctacgtgactctggagcaacgcctagcgtatgcttcctggatctcctttaccacaagaggcctgatcctgcccccacgccgactgacctggacttacaagtatttctttcccgtccattagcctactggttcctgcatcgtggactgaaccgctaagggccggggggccccttccctatggagctttcccggaaccatcggggacggctttcccaggaagcgtattga

SEQ ID NO: 87364 - DNA, 833 bp, Zea mays
  misc_feature: Ceres CLONE 1574371
  misc_feature: Encodes the peptide sequence at SEQ ID NO. 87365
ctggagctcaccgcggtggcggccgctctagaactagtggatcccccgggctgcaggaattcgtctcacccctagaaaaaatttccggatcccctcctctcgcactccccattcccctccgccgccgtctcacgcgcccgcgacccacccggactcccgcttcgatctcgccccgattcccccgctcgcgcccccaacccgattcgtccctctcacgcgcgcgcgggtgggaagacagcgatggcttggggcgggggcctctctccccgccgcgggtgacctctcctcgcgcggggagccctcccgcgtgcccacgcggaggatcccgtcgcggctggtgcactaccacctcctctccattcgccactcccccgtgctctctcgcgcgtcccctcgaccatagatagggtttgctcccttccttcctcgccgcccgatttgatctcgtcccttccgggctccggctaggctgctccgtctctcctcctccgccatgttctcgcacggcgctgattccgcccacgacgccgggaccgttggcgtcagcagcggcgtcggggccaccgtccccgcccgcttcgtctggccctacggtggggagagggtctttcgtctcaagctccttcaccagggggtcggaacatttgccgatgtctcctgtcgaaggctgccccactgtattttcaggctatttggcaccctgtctccaggggattcatggagtacaagttctatgggggacgggggaagtggcggtccatgattgaacgcccaaccctacctattttttggggagaatttcgggttataagttaaacacactcttatatttt

SEQ ID NO: 87365 - protein, 89 aa, Zea mays
  misc_feature: Ceres CLONE 1574371
MFSHGADSAHDAGTVGVSSGVGATVPARFVWPYGGERVFRLKLLHQGVGTFADVSCRRLPHCIFRLFGTLSPGDSWSTSSMGDGGSGGP

SEQ ID NO: 87366 - DNA, 750 bp, Zea mays
  misc_feature: Ceres CLONE 1574373
  misc_feature: Translation starting site: 610
  misc_feature: SWISSPROT Homolog: EC 1.1.1.34 Hydroxymethylglutaryl-CoA reductase (NADPH)
  misc_feature (341)..(341): n is a, c, t, g, unknown, or other
ctggagctccccgcggtggcggccgctctagaatagtggatcccccgggctgcaggaattcgtctcacccctagaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcgggtgatgcgctaccgctgccgatccggcacacgaacctcatcttctcggcgctgttcgccgcgtcgctggtgtacctgatgcgntcggtggcgggggaagatccgcgcctccacgccgctccacgtggtctcccccgccgagatcttcgccatctgcggcctcgtcgcgtcgctcatctacctcctcagcttcttcgggatcgccttcgtgcagtccgtcgtctccagcagcgacgacgacgaggacttcatcgtcgactcccgccaacgcgcgggcgcgggggcccccccacgcctgcccaaaaccccgtggggccctgcctggggaccccccccccccccgaacggaaaaatgcccgaaagaaggacaaaggaaattctgggccccggtttttggcaagggaaaaatccccgccccaacgtggcgggaaatttaaggcttgggaaaattgccccccggggccccccccgggattcaggggggggagggccc

SEQ ID NO: 87367 - DNA, 845 bp, Zea mays
  misc_feature: Ceres CLONE 1574376
  misc_feature: Encodes the peptide sequence at SEQ ID NO. 87368
aaagctggagctccccgcggtggcggccgctctagaactagtggatcccccgggctgcaggaattcgtctcacccctagaaaaaacctcgtgttcgttcggagcgcacacactcctgcttgatctccccctaatccatcccgtcggcacctccgcttcaagatgcagatctttgtgaaaaccctgaccgagcaagactatcaccctcgaggaggagtcgtctgacaccattgacaacgttaaggacaagatgcatgacaaggaaggcatccccgcagaccagcagcggctcatattcgctggctaacagcttgatgacgggcgcacacttgctgactacaacatccagaatgagagcaacgtgcgacttgtgctccgcctcacgggaggcatggacatctttgtgaaaacccatgaccggaaggactatcgccctcgaggtggagtcctctgacaccattgacaacgtcaaggccaagatgcaggacaatgagggcatcgctcctgaccaacgacggctcatctttgctgggaagcatcttgaggacgggcacacggttgccgactactacatccagaacgagagcaccctccacttggtgctgcgcctcaggggaggcatgcagatcttcgtgaagaccctgaccggcaaaactatcacccacggggtggaggcttcagaccccatccgaaaccgtcaaggccaaaatcccgggacaagaaggggattaaaccggaccagaagcaggctcatcttagcttggaaagaaccttgaaggacgggggccaagatgtgcggattaggacctgggggaatgagatataaccctccctctgggtgcctgt

SEQ ID NO: 87368 - protein, 120 aa, Zea mays
  misc_feature: Ceres CLONE 1574376
  misc_feature (1)..(67): Pfam Name: ubiquitin Pfam Description: Ubiquitin family
MTGRTIALEVESSDTIDNVKAKMQDNEGIAPDQRRLIFAGKHLEDGHTVADYYIQNESTLHLVLRLRGGMQIFVKTLTGKTITHGVEASDPIRNRQGQNPGTRRGLNRTRSRLILAWKEP

SEQ ID NO: 87369 - DNA, 837 bp, Zea mays
  misc_feature: Ceres CLONE 1574386
  misc_feature: Translation starting site: 416
  misc_feature (303)..(303): n is a, c, t, g, unknown, or other
aaagctggagctccccgcggtggcggccgctctagaactagtggatcccccgggctgcaggaattcgtctcacccctagaaaaagactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcnatcggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcggggcctgcgccaactgactcccggcgtttcgcggcggagctcagggccacccccggccggatcgccggcaatggcgcctgcgccgtcgcgtcactgtacacgctgcagggcaagaagggcgtcaaccaggatgctatgatcttctgggagaacttctgttcaagagagaaccatctttttgtggtgtgtttgacggccatggaccttatggccatttggttgccaggagagtaaggatctgctgcctctatagt

SEQ ID NO: 87370 - DNA, 814 bp, Zea mays
  misc_feature: Ceres CLONE 1574387
  misc_feature: Encodes the peptide sequence at SEQ ID NO. 87371
  misc_feature (814)..(814): n is a, c, t, g, unknown, or other
ccgcggtggcggccgctctagaactagtggatcccccgggctgcaggaattcgtctcacccctagaaaaagactcgctccgtgttccaagcgccttttgagcattcaggcagatataaaattcctctttttacgctacaatccccgctgaatcagcagcagcaactctctccctctccgttcttggtggtccgagacccttggacgtaagctctgcctcactcctccgtctcttgcttcccttgccgccggcggcgcgcggcgccgggcgcggatcggctgcaggtgcatggtggatgccgccgccgggcgccggacaggcaccagccgtcggcagcctagcggaagcggagaggagcaccggcacctggtcgacgttagctgtcgcccccccccccaccatggtaaccacccggtccgtgggtccagcagcactagcggaaagtgatggagcgggagctgctgtaacagatgacggcgccgctggcggtggcggacgatgcatggaggacttcttctacggcctccacggcttgctcggcgcgttaggcatgacatgggctgcgaacggggcccgcgccaactgactcccgggcgttcgcgggggcaactcagggaacaccctcccggccggaatcctcaggaaatggccccttgcggggggttcagttacctggaaccggcctgccaaggacaaacaaagggggccttaaccaaagaaaagctaatcaatcctttccgggggaaaaaccttccgtgcttcaaaaaagaatctattacgcctgtctttttctatttgggtcaaacgattaaan

SEQ ID NO: 87371 - protein, 96 aa, Zea mays
  misc_feature: Ceres CLONE 1574387
MPPPGAGQAPAVGSLAEAERSTGTWSTLAVAPPPTMVTTRSVGPAALAESDGAGAAVTDDGAAGGGGRCMEDFFYGLHGLLGALGMTWAANGARAN

SEQ ID NO: 87372 - DNA, 822 bp, Zea mays
  misc_feature: Ceres CLONE 1574388
  misc_feature: Encodes the peptide sequence at SEQ ID NO. 87373
  misc_feature (781)..(781): n is a, c, t, g, unknown, or other
ctggagctccccgcggtggcggccgctctagaactagtggatcccccgggctgcaggaattcgtctcacccctagaaaaaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgccagggcggcggtggcggccttgggcagagcatctctggcatcgtgcggatggcggtgttctggtacttcgcggccaagttcttcgggcccaagcgcccgcccgcggaccccgggattctcatgtccaacctcttccagaagggcgagccaatggatatgtggatgtatttatcagagagtgacaagttcaacgattttgctaatgaggacgcacttatttggcatgaggcaaacataccatatgcagtatggggacctaccagtactagaacacggtcattaacatactacccttcagaggctctcaagcataatggatctttgtatgctcatgtttactttgcccgctcgggttaccctgtggacccaacagatcctgaatatgagcagaaatctgcatttgggaggacgcaccctgttgtggcattcttgccaaaatcaaaagctggtaaaaagaagagcttgctttggggattcagaagagcctgaagagcaagcacccacctaaggggaataagaatttgaggataaagatgaaggtccgactngatatttatcttattgggaaacaaatgtaaccagtaaatca

SEQ ID NO: 87373 - protein, 184 aa, Zea mays
  misc_feature: Ceres CLONE 1574388
MSQPTAAVAAEAQPQGRGLAGRQGGGGGLGQSISGIVRMAVFWYFAAKFFGPKRPPADPGILMSNLFQKGEPMDMWMYLSESDKFNDFANEDALIWHEANIPYAVWGPTSTRTRSLTYYPSEALKHNGSLYAHVYFARSGYPVDPTDPEYEQKSAFGRTHPVVAFLPKSKAGKKKSLLWGFRRA

SEQ ID NO: 87374 - DNA, 816 bp, Zea mays
  misc_feature: Ceres CLONE 1574394
  misc_feature: Encodes the peptide sequence at SEQ ID NO. 87375
ctggagctcaccgcggtggcggccgctctagaactagtggatcccccgggctgcaggaattcgtctcacccctagaaaaagagaggaaaaggggacaaaccaccaacaacaaccagaatatcgcatcgccgtcgcgtcgtcgtcgatctccccgccccgcccgcgccgcggaatctgacacatctctctaatctctcctaggaccgggtgcccttacatccacgccgcaacgcaaatcgccgtccgagtcctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccgcgggaaggacgagtgaataatcatgagctcgctctgccctttcgcgggagccaccactggtggtggtgtatgccctgtgaaatctgataagatcaacactggggtgtgccctgcaaaatctgacaagagcgtcagcggtgtatgccctgtcactggcaaggatcatggtagcaagctcaaggaaagtggtgattcttggtgaaggaaaagggaccgaatcccccgggtcgttaccgcaaaaatgcccctttcgggtatgaactccccaaccttttcaaagccggggcccccccttacccggatttttcccgccccggggcacatttcccccggggaaaatgtgcaaaatttgccccccccccggtggggcccccaaaaaaattttttctccaagaagggggattttt

SEQ ID NO: 87375 - protein, 59 aa, Zea mays
  misc_feature: Ceres CLONE 1574394
MSSLCPFAGATTGGGVCPVKSDKINTGVCPAKSDKSVSGVCPVTGKDHGSKLKESGDSW

SEQ ID NO: 87376 - DNA, 739 bp, Zea mays
  misc_feature: Ceres CLONE 1574399
  misc_feature: Translation starting site: 198
  misc_feature: SWISSPROT Homolog: EC 2.3.1.119 Icosanoyl-CoA synthase
  misc_feature (481)..(481): n is a, c, t, g, unknown, or other
  misc_feature (484)..(484): n is a, c, t, g, unknown, or other
  misc_feature (515)..(515): n is a, c, t, g, unknown, or other
aaagctggagctccccgcggtggcggccgctctagaatagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagggtgtggggggaggccnacntacgacctcgccaccgtgctcgccttcctcngcgtcctcgccccttcacatctcgtctacatcatgtccaggcccaggcccgtgtacctcatcgacttcgcatgctacaaagcggccgacgagctcaaggtgccaagggcggagttcatcgaacttgggcccgcaagtccgggcaagttcgaccaaggacaagcccgggctttccaagtcgcgtttggcttggccaaagtccggcaatgggggaaaaaagtccta

SEQ ID NO: 87377 - DNA, 831 bp, Zea mays
  misc_feature: Ceres CLONE 1574402
  misc_feature: Encodes the peptide sequence at SEQ ID NO. 87378
tggagctccccgcggtggcggccgctctagaactagtggatcccccgggctgcaggaattcgtctcacccctagaaaaaaaccttgccagtctaccgcagtactgccgacttctagcagttgttttataggttagtttcgttgccttgtgtctttgttagtgtatcaaaaccaattcgcgacatcacttaggaaggggaaagcaggggccggaaaaagaagaagagacgggaatggcaagctccgactcaaatcccaccgatgcattcgagtacatgctgcttgagaaggatcctgatctctaccggacggttttctctggtccgagccagacaagcccatggattgacccgagtgtgttaaagctgaagcaccggatagggagaggtccatttggggatgtatggatagcaactcaccaccaaaggacagaggatttcgatcagtaccatgaggttgcggtgaagatgctgcatccaattaaagaggaccagctgcagatcttctcagcgaggttccatgagatcttcagcaaatgtcagggtctgggcaacgtttgtttcttgcatggcatctctacacagaatgggaggatttgtatagctatgaagttctatgaaggatccatcgggaacaagatggctcggcttaaaggtggaaagctccctttgtcagaagttctaagatatggggctgatttggcacgcggtgtactaggcctacacaccaggggggatattgatcctaaatatgaaaccttgcaattttctcatagacgaaaatgattgtgctgtgctggggggattttgggattccatccctgctgtttgga

SEQ ID NO: 87378 - protein, 183 aa, Zea mays
  misc_feature: Ceres CLONE 1574402
  misc_feature: SWISSPROT Homolog: EC 2.7.10.2 Non-specific protein-tyrosine kinase
MASSDSNPTDAFEYMLLEKDPDLYRTVFSGPSQTSPWIDPSVLKLKHRIGRGPFGDVWIATHHQRTEDFDQYHEVAVKMLHPIKEDQLQIFSARFHEIFSKCQGLGNVCFLHGISTQNGRICIAMKFYEGSIGNKMARLKGGKLPLSEVLRYGADLARGVLGLHTRGDIDPKYETLQFSHRRK

SEQ ID NO: 87379 - DNA, 806 bp, Zea mays
  misc_feature: Ceres CLONE 1574404
  misc_feature: Encodes the peptide sequence at SEQ ID NO. 87380
ctggagctccccgcggtggcggccgctctagaactagtggatcccccgggctgcaggaattcgtctcacccctagaaaaaccttcgatgggattccccaaagcaactgtccgatcccatcgcgatggcaccgccgccgcaggagccaatccaccgccactgacgtaacccgatccatggaaggagtaggatcttccgattacccccctcctcctcccaccttcctccgctccacccgccatatcctcgcctccctcgtcggcgcaaaccacacctccgcccgcttctgctcccgctagcaccaccaccagcaccggaccccttcccttcgcctccctcaccaggggtgacgggggcatggacccctcctccccgccgcggcgctgctccctcctcctccgcctgctcctcctcgccgtcgccgccctcgcgctccgtctcctctacggcgccttcctctccgtctccgccgggcccgcaggctggccgctctaccgccccgccgccaccgccacaaccaccacgcggaggaggacccacgtcgtccaggccgacgtcccgtcgccggaggtctggcgcacccgccactggcgcagggccgtcgactaccacgcggccatcctcgcgccgcacatcgccgccggcgccctcgcgcccgcgtcccgcgccgtctgcctgggcggcccgcaggaagcgctcgcgatgcgggagctcggcgtcgccaaagccgtcgccgtcggcaggaagcgtgcgcccacgctcgtcgtcgcggggggcgaccggagactgccgttcgactcgtcgtcc

SEQ ID NO: 87380 - protein, 35 aa, Zea mays
  misc_feature: Ceres CLONE 1574404
MRELGVAKAVAVGRKRAPTLVVAGGDRRLPFDSSS

SEQ ID NO: 87381 - DNA, 1218 bp, Zea mays
  misc_feature: Ceres CLONE 1574408
  misc_feature (64)..(64): n is a, c, t, g, unknown, or other
  misc_feature (73)..(73): n is a, c, t, g, unknown, or other
  misc_feature (805)..(805): n is a, c, t, g, unknown, or other
  misc_feature (1089)..(1089): n is a, c, t, g, unknown, or other
tttccaagcgttggtttggtattgttattatatctatcaacgcaaatacaacagagagataggnggggggggngcaaactggagctccccgcggtggcggccgctctagactagtggatcccccgggctgcaggaattcgtctcacccctagaaaaagtccggcgtgcctgtgagagcgggagaagctcggacatctccggtatggttccactggtccaggggacaaaatctgctgccagtttctgcaattgcttgttttttttcgctgtgttttcagtggagggacatcttctccagcgattcagcgcaggatcctgctggactggcctgatcactccctgctggtgtcggcgagcatggaaggaaggatgcgaggggcccggcggagcgcgcgcggggaatcttccccgaaggcggcgggcctccaggtggagtgatacaccccgtgcggcgacattttggggttggggggggccccccccccaaccctgaccgcagggattccgggggacccccttccaaccgcccggggggaggaccctttctccagacttgcgaaaactggcggtcctgagcaactggaaaggccccgcgccccaccgggggtcggggggacccgagcgtttccatccttcgggggggccaaaaatttgtaaggcttgggttagttttttgaggcgggctgagaagaggtctgtattagtattctctaggtctggctctctacaaaaaaaaagtggagagacgataatcctaaatatctacgagcaagagatattggtacatctcgtgctgcttgagagntccacatcatatcacctataagtgagtgagagttcacttataaggaggtaacggatggcgcgcttctctgttgctgtgtggtgagcactatcctaaatcgtaagtacatttttataagcagggctgttgggagggacgctccgctcctctcttgcgtcccgagttcgtggtgtgataggctcatcccatctccctttcacagcagaggtacaggacatagccccacctccggaactagtggaacatggtgtaatatgaggatgatttctggatgaaacgttacntagagcgggcgtagccaacccctcggcagaccacgactgctcggccctattgtcggctccttttaggctaaggtaagcccgtgccctactctcatagaacgaccagggtaacatagtccggttattatg

SEQ ID NO: 87382 - DNA, 792 bp, Zea mays
  misc_feature: Ceres CLONE 1574410
  misc_feature: Encodes the peptide sequence at SEQ ID NO. 87383
  misc_feature (50)..(50): n is a, c, t, g, unknown, or other
  misc_feature (51)..(51): n is a, c, t, g, unknown, or other
  misc_feature (68)..(68): n is a, c, t, g, unknown, or other
  misc_feature (69)..(69): n is a, c, t, g, unknown, or other
  misc_feature (311)..(311): n is a, c, t, g, unknown, or other
  misc_feature (767)..(767): n is a, c, t, g, unknown, or other
caagctggactccccgcggtggcggccgctctagaactagtgggatcccnnccgggctgcagggaatnntcgtctcacccctagaaaaagtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaacatccgcctgccgtccgagcgcgcggcggccgacgaaaacgacgacgacgccgtcnggaccgggtggccgtgctcatcgccgggctcaaacggctactacaacttacggccacaaggcggacatctgccatgcatacccgatcattgaaaagggccgaacttagagacgagaacatccttggccttcaggtacaaagaaatccccccaatgcccccgaaaatcccaaggccggggggctccctaaaaaattcccccgggggggggaaacctcttgcggggggggccaaagatttaccccggggggaaaaattcaaacccccaaaaattttttcccccggtttccggggggagaaaaaaaaaaaccccttcccaggggggggggagacccccaaatgttgttgaaaaaaagggggccccccaaaaagaaaaaaatattgtgtggtttccacaaaaaaacaaaaaaagggggggcccccccgcccccccccctgggaagaaaacaccccccaanccccacatattcccctcgggggggg

SEQ ID NO: 87383 - protein, 76 aa, Zea mays
  misc_feature: Ceres CLONE 1574410
  misc_feature (47)..(47): Xaa is any aa, unknown, or other
MVADRLRLALLLSACLCSAWARPRLEPNIRLPSERAAADENDDDAVXTGWPCSSPGSNGYYNLRPQGGHLPCIPDH

SEQ ID NO: 87384 - DNA, 808 bp, Zea mays
  misc_feature: Ceres CLONE 1574414
  misc_feature: Encodes the peptide sequence at SEQ ID NO. 87385
  misc_feature (327)..(327): n is a, c, t, g, unknown, or other
  misc_feature (475)..(475): n is a, c, t, g, unknown, or other
tggagctccccgcggtggcggccgctctagaactagtggatcccccgggctgcaggaattcgtctcacccctagaaaaaacctcgtgcctcccctcctccccccttcccctctctcgcccctcctccctccgtctcgtctcccaggtcatggcaaaagctggagcaccgggaaaaatagcaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggnttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcnaccagtgcgtgatgggggaagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagaccgcggcaaggatcccatggctagcggtgggggcctagccgacggctcatccaaaccaaggcagtcgcaggagcaagcccggcgcaagaagatgtctcgcccgcagacagctccccaagactgcccaaaataaggaggggtcccccccccgggttttttttacgaaa

SEQ ID NO: 87385 - protein, 52 aa, Zea mays
  misc_feature: Ceres CLONE 1574414
  misc_feature (45)..(45): Xaa is any aa, unknown, or other
MMGGGLMMDQSVVFPGVHNFVDLLQQNGDKNLGFASLMPQTSSGXQCVMGEG

SEQ ID NO: 87386 - DNA, 971 bp, Zea mays
  misc_feature: Ceres CLONE 1574415
  misc_feature (67)..(67): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
gtttggaggtttgttggttccttttttaacaatcaaattaaagatgggtgttgggaggcgaaaaatnntttnnnntcaaagctggaactccccgcggtggcggccgctctagaatagtggatcccccgggctgcaggaattcgtctcacccctagaaaaaacctcgtgcctcccctcctccccccttcccctctctcgcccctcctccctccgtctcgtctcccaggtcatggcaaaagctggagcaccgggaaaaatagcaagtgggagataaacaggaagagctaggtgaatacttggagaaaaaggtcccccacaccccccacgcaggtgaatactacaagtagcagtacaatgaagagagccaatctgcccgtgactgcgagtgaattgctagggtgtggtggttagttgaggtcacgtatgatgggaggcgggctgatgatggatcagagcgtggtgttccctggcgtccagaactccccccatctcctgcagcagaacggcgacaagaacctgggcttcgcctcactcatgccacaaacatcctccggcgaccaacgcttgatgggggagggtgatcttgtggacccaccaccagacagctttcccggacgccgttggagtaccacagcccatgaccgacttttgaggacatcgaaggaagctggaggcgccgcaatgttggtggcgaaccgcatgaagccttaaagcagccttcagggaagcctgccaccagaaaccggcggcaaaggaatccccatggcctagcgggtgggggagtcctaatcccaacaggctcattccaaaatccaagggcacctccgcaccgaaccggggccccgggcacccagtaaaaacttgtccccgtcgcccccaaagaacaggacattcctttaaagttaacaacgccctctacaacttacaacggaacggtgttgccacgccgccgcccagtgggggtttagtat

SEQ ID NO: 87387 - DNA, 858 bp, Zea mays
  misc_feature: Ceres CLONE 1574419
  misc_feature: Encodes the peptide sequence at SEQ ID NO. 87388
  misc_feature (835)..(835): n is a, c, t, g, unknown, or other
ctggagctccccgcggtggcggccgctctagaactagtggatcccccgggctgcaggaattcgtctcacccctagaaaaaaaaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtttaatacgtacattggctgacatgaagtacggcaactataaaatgacaccagtggaaatagcatacaacgccatttccttcgtcatcgctatcgccctcacggtcgccttcacggtacgcgaagagagctctgggtgacataaaaagtccggacgatggcatcggtaaagacgaagaagatcacggcccaaatggctcaggggtgcgtatgaaatcgtcgtcaggagcgtgccgacgcacgttacatagaactagatgatatgtgatggtgtgttggcccggatcttgcttgggaagaggcaccagtagggcattaggtgcacggctaccggtagtagccaactatagtttaccagaggaggctaaaataaaccccccccagcttaaatgggtttgcgtgaaatcctttcggggggcctttgcccaattgaacgggcatatacgggctgaaacctgaaaagggcaggggctaccccaccaaacggaagtttcctggacccaacgaatatccttctttctaaaaaaaattttttccgtggtaacacccccaccgcttttttaatttanagccccttggatatttaaaaaac

SEQ ID NO: 87388 - protein, 58 aa, Zea mays
  misc_feature: Ceres CLONE 1574419
MVPEAFIYIYSGRLIRTLADMKYGNYKMTPVEIAYNAISFVIAIALTVAFTVREESSG

SEQ ID NO: 87389 - DNA, 795 bp, Zea mays
  misc_feature: Ceres CLONE 1574420
  misc_feature: Encodes the peptide sequence at SEQ ID NO. 87390
ctggagctccccgcggtggcggccgctctagaactagtggatcccccgggctgcaggaattcgtctcacccctagaaaaaacctctccttccctccacccgcgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtcttttgaagggaccttctgggaatagacaacaaataccccaaccggtgcagttttacagggggaagggttttggaaaaaacccccggggtccccacctttggaaaaaaggccctgggggggggccccccacttttttaatagagggggggggggggagagaaaaaaaaaccactttttttaataagaggggcgccccccccccccccccttttttattttttttttttgggattgggagaagaaacacaaaacaacgaaggggggaggtgagaatttgacccctgctgcgtgggggaggaagagggggaaagatgttatataaaataaaacacacaacacaggcataaaggaacagcgggagtggtgatg

SEQ ID NO: 87390 - protein, 73 aa, Zea mays
  misc_feature: Ceres CLONE 1574420
  misc_feature: SWISSPROT Homolog: EC 3.6.3.14 H(+)-transporting two-sector ATPase
MGLVKEGIDMEEGTLEIGMEYRTVSGVAGPLVILDKVKGPKYQEIVNIRLGDGTNRRGQVLEVDGEKAVVQVF

SEQ ID NO: 87391 - DNA, 812 bp, Zea mays
  misc_feature: Ceres CLONE 1574424
  misc_feature: Encodes the peptide sequence at SEQ ID NO. 87392
tggagctccccgcggtggcggccgctctagaactagtggatcccccgggctgcaggaattcgtctcacccctagaaaaaacggcagctctgaagcgagaaagagatcgatcgtattcgtatccgcggaacaagcagcgaaggatcggagcctatccaatggccgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcaggagcagcctgcggcggcagcaggcgacgacgcggcgcccaagtcaccggcgccggaggcgcccaaggagccggcggcggtgcctgcgccggccgcggaggaaggcagcaagtcgtcggaggggttcggcctcggcgacgtcatgaagggcgccgagcagctggtgggagggaataagcagggcggcggggaggagagcgccgggcgcggtgggctgtttaagatggcccagggcttcctcaagtagatattgtctggccaacttatataccagtacgctaatagcttcaaaataatgttccccctcgcactttatttggctggtccagtcccctggtattaaccgaagaaccgttatttgttagcaagggaggtttttttttaaaaaattcagcggatgcccc

SEQ ID NO: 87392 - protein, 165 aa, Zea mays
  misc_feature: Ceres CLONE 1574424
MAEGKSSSGGDLFSSGKLVAGAAVSVFQQKSVENVDKQEVAGAAAELLHAASAYGKLDDKPAGQYVEKAEGYLKEFSAGHATEQEQPAAAAGDDAAPKSPAPEAPKEPAAVPAPAAEEGSKSSEGFGLGDVMKGAEQLVGGNKQGGGEESAGRGGLFKMAQGFLK

SEQ ID NO: 87393 - DNA, 790 bp, Zea mays
  misc_feature: Ceres CLONE 1574431
  misc_feature (262)..(262): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (275)..(275): n is a, c, t, g, unknown, or other
  misc_feature (279)..(279): n is a, c, t, g, unknown, or other
  misc_feature (291)..(291): n is a, c, t, g, unknown, or other
  misc_feature (387)..(387): n is a, c, t, g, unknown, or other
  misc_feature (398)..(398): n is a, c, t, g, unknown, or other
  misc_feature (430)..(430): n is a, c, t, g, unknown, or other
  misc_feature (704)..(704): n is a, c, t, g, unknown, or other
  misc_feature (728)..(728): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (770)..(770): n is a, c, t, g, unknown, or other
ctggagctccccgcggtggcggccgctctagaactagtggatcccccgggctgcaggaattcgtctcacccctagaaaaaaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccnatggnnnctgctncaanactggcatcacngcactatacgagctgctgcacgaagcagcagcagcgcaacgagctctgctgctcgcgatccccttctccctgctgctcctgccgctcctgctccgnctacctcgcangcgtcggggcgtcggcgtcggcgagagaccgnaaccgaaacggcgcccggccagcgtaccccgaaaaaagcttcttgaagcctggctggccgtccgccgccccaatgaaagctccccattaattgggggaaccgggcccctggaagggggggaaatccccccttaaggtggtttcccccttttggggggggggtttggccaaaaaagaggtttaagggcccccggaaacaaaaaaggtgtggttcccccccccttggggggcgcggggtggggaaaaaaccggggggggggggggtgttttccctnttttgacccgccccccccgccggngtggnnnnccgtcggtggagcccccaaaaaaaagaaaaaagngagggcgcgtgcgtgcttct

SEQ ID NO: 87394 - DNA, 811 bp, Zea mays
  misc_feature: Ceres CLONE 1574437
  misc_feature: Encodes the peptide sequence at SEQ ID NO. 87395
  misc_feature (114)..(114): n is a, c, t, g, unknown, or other
ggagctccccgcggtggcggccgctctagaatagtggatcccccgggctgcaggaattcgtctcacccctagaaaaaaaaaaaaaaaaaaaaaaagaccgcttcttcgcaaacnctccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatgctcggcaccaccgtcctcatcgccaccatcatcgtcccgctcatgggcggcggccatgccgagaaggcgatcgtgatccagaccatccctgtccctctcgggatcaacacgctgctgcaggtccacttcggcacgcgggccccccgccgtgatgagccgctcctacactacatctacccgggcggtggcatccatcctgagcccgcgatacgcgctcctcatcgaccctttcaaaaaattctggtcccgaaagaaggccgctcagggcggccttaataatcgccgggggtttttcaagcgcgtgttcgggttctttggggaatgggaaaaactttaattaaggtcccggaacccccctggggggggcccccctttttacagctcaaaggggccggggatcttttttttttcgggttttcccggg

SEQ ID NO: 87395 - protein, 136 aa, Zea mays
  misc_feature: Ceres CLONE 1574437
MPPVKAEDLVVHAVKEQFAGLDYCITSPPPWITTVLVGFQHYLVMLGTTVLIATIIVPLMGGGHAEKAIVIQTIPVPLGINTLLQVHFGTRAPRRDEPLLHYIYPGGGIHPEPAIRAPHRPFQKILVPKEGRSGRP

SEQ ID NO: 87396 - DNA, 780 bp, Zea mays
  misc_feature: Ceres CLONE 1574439
  misc_feature: Translation starting site: 269
ggagctccccgcggtggcggccgctctagaactagtggatcccccgggctgcaggaattcgtctcacccctagaaaaagattaaacaattctgaaacacaaagtaggggcctcttcgcaaatcccaccagcaccaccgccttcgcctccgaccgcctcccagatccgctcgcccggccgccgtcgtcttcctggtccgcctctgcggcagtgagattcctcgccgccccgccctggattccgtcgagaggatcgtcgaggacttcgcgatggacctcgccatcaaccccttctcctccggcacccgccttcgggacatgatacgtgcgatacgcgcgtgcaagacggcagcggaggagcgtgccgtggtgcggcgggagtgcgcggcgatacccgcctccatcagcgagggcgaccaggactaccggcatcggaacatggccaagcttatgttcatccacatgctcggttaccccacacacttcgggcagatggagtgcctcaagcttattgctgcggcgggcttccccgagaagcgcatcggctatctagggactcatgcttctgctcgacgagcggcaggaggtcctcatgctcgtcaccaactctctcaagcaagatcttaaccactcaaaccagttcattgttggggcttgcgctctgtgcccttggcaacatatgttctgctgaaatggcacgcgatctggctcctgaagtggagagactgttgcaaaatagggaccctaatacaaagaagaaagcggctttatgctctataagg

SEQ ID NO: 87397 - DNA, 825 bp, Zea mays
  misc_feature: Ceres CLONE 1574440
  misc_feature: Translation starting site: 203
  misc_feature: SWISSPROT Homolog: EC 3.4.21.25 Cucumisin
  misc_feature (617)..(617): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (764)..(764): n is a, c, t, g, unknown, or other
ggagctccccgcggtggcggccgctctagaatagtggatcccccgggctgcaggaattcgtctcacccctagaaaaagaacccacggccacgccccaccctcactccccttctgcccttcgcccgcatacacattgccccgcaagctaccggcgaacgcctagcatctgtggcgccgcgccgcgccgcctccgcctccgctgatggggatgaacaagtcacggtggtgtcgcgccaccctgctgctgctcctgtcccttgctctccgcggcgcggcgttcctgcaggagcggaagaactacatcgtgcacctccggccctggaagccgccgacggctccgtcgacgagtggcaccgctcgttcctgcagcaggcggcggcagggctggactccgcggccgacgacggcccgcagatcatatactcctatagcgacgtcttcaccggcttcgccgcgcggctcacggacgccgaagcagaggcgctgagggccacggacgggtgcgtgcggctgtacccggaggtgttcctgccgctcgccaccacccgctcgccgggcttcctcggcctccacctggggaacgagggcttctggagccgctccggattcgggcgcgnggtgggtgattgggatcctggacacggggatcctgcccagccacccgtccttcggcgacgacgggctccagccgccgcccaaagggtgggaaggggacctgcgagttcaagagcatcgccgggggcggatgcnanncacagatcatncggggcgcgcgccgttcgggagcgcggcggtgaactcgacgggcgccgcccgtcgacgacc

SEQ ID NO: 87398 - DNA, 825 bp, Zea mays
  misc_feature: Ceres CLONE 1574443
  misc_feature: Encodes the peptide sequence at SEQ ID NO. 87399
  misc_feature (682)..(682): n is a, c, t, g, unknown, or other
  misc_feature (685)..(685): n is a, c, t, g, unknown, or other
  misc_feature (696)..(696): n is a, c, t, g, unknown, or other
ctggagctccccgcggtggcggccgctctagaactagtggatcccccgggctgcaggaattcgtctcacccctagaaaaaaacagtgtgcactgtctctcccatgctttctcttggtaggtgttctctgcctgcctcctccaaccccggcccctcactagaattcttgtcgcaagcacacaccatgatctgttacatgctgtggttagcggcatgctgcctcctcctcttgtacagcgttcgattcaggtccggctggagccatggcaacggccccaggagctaccccgtgattgggtgcctggtcgacttctacaagaaccggtggcggctgctggactggtacactgagctgctggcggcgtcgccgacgcagacgatcgtggtggaccggctgggcgcccggcgcaccgtggtgaccgcgaaccccgtgaacgttgagcatattctcaagagcaacttcggcaactaccccaaggggaagcccttcaccgacatcctcggcgacctgctgggcaccggcatcttcaacgtcgacggcgagctgtggtacgcgcagcggaagctggtgagccacgagttctcggcgcgcgcgctccgggagctggagttcgccgtgctcgaagacgaagcgcgggagcgccttgtgcccgccctgggccctgcggctgcgcgcggcgacntcntggacatgcangaccctgctccggcgcttctcgttcgacgtcatctgccgcgtgtcgctgggcgttgaaccccggtgcctggacctgcattggcggcgccaaagttggcccccggcttcaacccgggggccggggataat

SEQ ID NO: 87399 - protein, 189 aa, Zea mays
  misc_feature: Ceres CLONE 1574443
  misc_feature (167)..(167): Xaa is any aa, unknown, or other
  misc_feature (168)..(168): Xaa is any aa, unknown, or other
  misc_feature (171)..(171): Xaa is any aa, unknown, or other
MICYMLWLAACCLLLLYSVRFRSGWSHGNGPRSYPVIGCLVDFYKNRWRLLDWYTELLAASPTQTIVVDRLGARRTVVTANPVNVEHILKSNFGNYPKGKPFTDILGDLLGTGIFNVDGELWYAQRKLVSHEFSARALRELEFAVLEDEARERLVPALGPAAARGDXXDMXDPAPALLVRRHLPRVAGR

SEQ ID NO: 87400 - DNA, 814 bp, Zea mays
  misc_feature: Ceres CLONE 1574446
  misc_feature: Encodes the peptide sequence at SEQ ID NO. 87401
tccccgcggtggcggccgctctagaatagtggatcccccgggctgcaggaattcgtctcacccctagaaaaagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcagacgggaagagcgtgctgcatgggcggtacgagctggggcggccccccccccacggcaacttctggcgggtgcacgcggcgcgggacctgcgcacgggccgcagcgtcgcggacaaggtggtggccaaagacaagctggagcgcgcgggcatggcggatcaaatcaagcgggaaatcgccgtcatggagatggtgttccaccccaacaccctggaacttcacgaggtgatgggccccccgctcacagatctacctcgcgcctcgactcgtccccggcgggggaacttcttcctccctaatccctccccccgggggcgggtcccaggaagggaactgggccccgtttttttacttccgggcaagactcttcgacgcggggatcaaaatttttgcccaaggacccgcgggggtggtttcccacccccaagaccctggaagacctcggaaaaaactaaggttccccat

SEQ ID NO: 87401 - protein, 162 aa, Zea mays
  misc_feature: Ceres CLONE 1574446
  misc_feature: SWISSPROT Homolog: EC 2.7.11.1 Non-specific serine/threonine protein kinase
MEDAMAADGKSVLHGRYELGRPPPHGNFWRVHAARDLRTGRSVADKVVAKDKLERAGMADQIKREIAVMEMVFHPNTLELHEVMGPPLTDLPRASTRPRRGNFFLPNPSPRGRVPGRELGPVFLLPGKTLRRGDQNFCPRTRGGGFPPPRPWKTSEKTKVPH

SEQ ID NO: 87402 - DNA, 837 bp, Zea mays
  misc_feature: Ceres CLONE 1574448
  misc_feature: Encodes the peptide sequence at SEQ ID NO. 87403
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (763)..(763): n is a, c, t, g, unknown, or other
ctggagctccccgcggtggcggccgctctagaactagtggatcccccgggctgcaggaattcgtctcacccctagaaaaaagcctcgagcaccgggacctgccgcgtgcttcttactggcaacttggcaagtggcacggccgcacggatccatctccatcgtcgaggcgaggacgaggaagcagatcgaagcacccaaccacaccacactggtggtgagtggttgctggcgatggccatggaagcgatgatgagcgggctcaactccggcgtggtgctcagcctgatcgccgtgctgtggacggtggtgtggcagaacctgcagcacctgcagctgcagcagttcttcgcgcggcagctgagccggcgcgcgcggcggctgggcggcgatggtggacccgtacctgtcggtcaccatcgccgagtacgagggcgggcggatgaagcgcagcgacgcgtacgaggaggtcaaggcctacctcagcgacgccagcgcccacggcgtgcgccacctccgggccgagtccgccaaggacgccgacaagctcgtgctcagcatgtcggacggcgaggaggtggaggacgacttcgagggcgcgagggtctggtggtgggcctactccaagcagccgccgcgctcggacggccccgcgttgttggaaattagnnnggggggggggtccccgggggaaggagggagcgcccacttctaccgcccctcttcttcctgggagcacagccggtcgcctggttgctgggacacngtaccctccccgcgcgtcccgcccagctggggcccgcgcccgttccatgggtggatgaaaccgcccaggcggga

SEQ ID NO: 87403 - protein, 149 aa, Zea mays
  misc_feature: Ceres CLONE 1574448
  misc_feature (93)..(93): Xaa is any aa, unknown, or other
  misc_feature (94)..(94): Xaa is any aa, unknown, or other
MVDPYLSVTIAEYEGGRMKRSDAYEEVKAYLSDASAHGVRHLRAESAKDADKLVLSMSDGEEVEDDFEGARVWWWAYSKQPPRSDGPALLEIXXGGGSPGEGGSAHFYRPSSSWEHSRSPGCWDTVPSPRVPPSWGPRPFHGWMKPPRR

SEQ ID NO: 87404 - DNA, 787 bp, Zea mays
  misc_feature: Ceres CLONE 1574457
  misc_feature: Encodes the peptide sequence at SEQ ID NO. 87405
  misc_feature (632)..(632): n is a, c, t, g, unknown, or other
aaagctggagctccccgcggtggcggccgctctagaactagtggatcccccgggctgcaggaattcgtctcacccctagaaaaactctctcctcctcaaggctcaagcgaaggcgagcgcgatagaaagctcaagccacttcccaacccgctccccccctcgccgcgatttcctcacatggcagcgctgcgcctccgcgagtcactcgagaggaacagcccctgctcctgcttctccgacccctgtccctgcgccgccaacacgcgccgcccccgtcccgatctcgccgcccccgccgccgggcccttctcgtccctccgcgtccatcgcccctgctcctgatccggctctcttcttcctcccttctcgcgccgtagattgcagccgcggctctgattctgctcccgccgtttgtctcgcggtcgcgggttcctgggagcttctgggttctggctccgtccctaaccggtgttgccatggggaagagcaagaagagcaaggcccgcggcggcggggacgacctgatcgacagcagcgacgccgacagcgtcggctcgtcgtccaccgcgctgtcggatctctccatctcgtacgccaccgagcacgtcaactcgcagggagtcgtcctcgancagtacatcgacgcgctctacgagaaagagggaatctacagagaggcagcattggttaaactcgttgatgccttcgaaagttttatgctccatgggccttgtggaaacaagtatggcacctggctgaatcaattccaacattctggcaaaaaaga

SEQ ID NO: 87405 - protein, 103 aa, Zea mays
  misc_feature: Ceres CLONE 1574457
  misc_feature (52)..(52): Xaa is any aa, unknown, or other
MGKSKKSKARGGGDDLIDSSDADSVGSSSTALSDLSISYATEHVNSQGVVLXQYIDALYEKEGIYREAALVKLVDAFESFMLHGPCGNKYGTWLNQFQHSGKK

SEQ ID NO: 87406 - DNA, 1066 bp, Zea mays
  misc_feature: Ceres CLONE 1574460
  misc_feature: Encodes the peptide sequence at SEQ ID NO. 87407
  misc_feature (1)..(1): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (606)..(606): n is a, c, t, g, unknown, or other
  misc_feature (607)..(607): n is a, c, t, g, unknown, or other
  misc_feature (858)..(858): n is a, c, t, g, unknown, or other
  misc_feature (985)..(985): n is a, c, t, g, unknown, or other
ntttttttttacgatatttttttgttttttattcttttatatattaattttatggcggggannntanaatatatatttaaaagctggagctccccgcggtggcggccgctctagaactagtggatcccccgggctgcaggaattcgtctcacccctagaaaaagacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaagctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctggctcgccctgcgtcggcgggcttcctcgccgaannccaagaatcgggccgcttacgctcaccaatcgcccatctccggccacaaatcggccgcccaccggggcggtgaggctttgtctggacggggggggacaacgaacgggttgaccaaaagcaatgactttcccaacccggacgtggtcccttgggaaccgcacccggcggggggcccgttgcccgcggcaaggaaattaggcggtgtgcctgggcttcgaccgggtgggagggcaggcctgggggggacgtgnctaggtataccgcggggacgactggttaccaacaagcgggggactgggcggggaggggccccaggcgaggggcctctcaaagcggcgtagaactgttattatccgggtggatcacaggggataccgnggaagaccaagattatttaaaacagggggacagaaccaaaaccaccataagtgggtaaggggaaaacaacccggcaccaaa

SEQ ID NO: 87407 - protein, 121 aa, Zea mays
  misc_feature: Ceres CLONE 1574460
  misc_feature (98)..(98): Xaa is any aa, unknown, or other
MVSGAGHGGYGGGDDGQAVDFRGNPADKSRTGSWLGAGLILGTELAERVCVMGISMNLVTYLVGELHLSNSKSATVVTNFMGTLNLARPASAGFLAEXQESGRLRSPIAHLRPQIGRPPGR

SEQ ID NO: 87408 - DNA, 917 bp, Zea mays
  misc_feature: Ceres CLONE 1574461
  misc_feature (554)..(554): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaagcagaagccgcagcctcgccccacgcccccacaactagccgtatcgactactccctcttgtcctgctcgggtggtccgcggtcgggctgacttgaatgagcagctttgcttctccatctacgaattcgcttccctccccatccccccccgcccggttgccgtacttgactctgaccccacaacgctagctatctcggctgaaccgcaggaggctcgtccgcgacctgagagcaacatgcagcaccggaccggatcaccgcacgcgaccgcgcataaaagatggcgtgagcacgcaccatgtggagacaagctgtcggcgtatcgaggctgcacgccccagcgcgacatacttaaaagcgtgctgacaaccccgccaaggggtcccgcgtctcgccacaggagctgagaagcaactggaaaagggcaccacggcgagaagctcgccctacatctatctgcgctctagaacgggcnctggagagtcacacagccgagattacctctgcgacgagtggatttccgatcccagcctactcctacatactacccagggtggatccacttggctcatcaggtcacccagcattcagcaaacaagactgcgatcgactctcggctcggaaactccttgcctgctcctgcctcgcgtgaaaaccatccggccaagtcgacacctctcccggatcccagcgtttcccttaactgtaagggccgatgggccctgacgaaacggaggacagggccaagaccccaatggggggcccctccctcgaaataaggtgggtttgaactgccngaggcaccttggcataataaattcataaaggctggagggtc

SEQ ID NO: 87409 - DNA, 1090 bp, Zea mays
  misc_feature: Ceres CLONE 1574463
  misc_feature: Encodes the peptide sequence at SEQ ID NO. 87410
  misc_feature (13)..(13): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (62)..(62): n is a, c, t, g, unknown, or other
  misc_feature (66)..(66): n is a, c, t, g, unknown, or other
  misc_feature (857)..(857): n is a, c, t, g, unknown, or other
  misc_feature (1080)..(1080): n is a, c, t, g, unknown, or other
gatgcgggggttntttgtcattgtttctcattataagaatgaaaccacgcaagtggnnncangttnggtgttattgtttcaaaactggagctcaccgcggtggcggccgctctagaatagtggatcccccgggctgcaggaattcgtctcacccctagaaaaagaggccagggcatccacgaccacgacacggacacagggagccgcccgccatgccaccgcacggcggcatactcgcgtacgccgccctcgcgctcgcggcgctgcggctgctgctgtcctacaagtcggcgctctacgcgctgcgccgcctgtggcggtgcgccgacgagtgggcgcaggcgtaccagtaccacaaggtgccgcgcttcgccggggcccagtgcgggtgcgacggcgcagagaacccgctgttccgcaaggtcgccgcgtaagtggcggagctgccgtcgctggaggacgccgactctgcgtgagtggcccccctcggcgtcaaggaccaacggcgggctgttccctgcagcctcgggcccgggccacacccgcgaggggaacacgatacctttggcggcgcggccctcgcgttgggacccaagcgcggggccggcgaagccgcccttggacgccttgcgacgttgacagcacgtctaacgaacccgaccatccccggcgataggctgacggaccccttaaccgttggcaagacaaacggtgtgaaagataccgttggcgccaggaaggcgaagataatggtgaagacacatccgcccccggcccgcgcggtaaggcatgggcgggcaccttcttttcaagcaccaaaatacacgagctctgctggggaaacgcccgtacccaancagggatcggccatcccgtcagccttgggggacggtctcgggcgtgaccccttttcttcctacaaccgcggagcccatcgctcttcgaaacagcccaatgagatccaatagagaaaccccggagacccttcgaggaggcacccgccgtatcccagcgccgctaaccttgggagaaagcctttccatcaaaaggggtcctgcccgcctatatctaacccagccntaacttcggg

SEQ ID NO: 87410 - protein, 73 aa, Zea mays
  misc_feature: Ceres CLONE 1574463
MPPHGGILAYAALALAALRLLLSYKSALYALRRLWRCADEWAQAYQYHKVPRFAGAQCGCDGAENPLFRKVAA

SEQ ID NO: 87411 - DNA, 1170 bp, Zea mays
  misc_feature: Ceres CLONE 1574464
  misc_feature: Encodes the peptide sequence at SEQ ID NO. 87412
  misc_feature (69)..(69): n is a, c, t, g, unknown, or other
  misc_feature (73)..(73): n is a, c, t, g, unknown, or other
  misc_feature (75)..(75): n is a, c, t, g, unknown, or other
  misc_feature (769)..(769): n is a, c, t, g, unknown, or other
ttctctgttgtcgtgggtcctccccccacgcgcgcgacgagcaagagacaaaaaataaaatatttaatntttngntgaagctggtactccccgcgtggcggccgctctagaatagtggatcccccgggctgcaggaattcgtctcacccctagaaaaaaggcgtcggatcggagcgagctcattctcaactcgactcaagagctctgcctcctccatctccccttctctggcctccggagccacgctgagagatggaggcgaatcccaagaacaccttcacgatgaaagtggaggacaggaagcccgggaaggacggccggctggcggtcggaccggtgttcccgagcgttctggccaaggatgggttcccgcagcttgagcctgacatgaatacatcatgggacgtgttcaaggtagcaccagtcaagtatgccgacaaccggatgctcggagggggggcgtgcatagatggaccccccccccccctacttgtggaaatcatacaaggagatctacgacgaaggtgcctgcatgcagggctctgcgttggaagaaacctgagaagtagcaacctaggtttccccggggtgggggatctgacgggaagataaaaatgtcccctcgactgggaataagagggacaagtgccacggcttctggcaaattggggactaattagttacctaacgctcttggggtgatccccataccatgcttaaacagaattaacgctctttatgtgcatggaccgtagtgccaacgccttgngctccggagaaccatcaaagaaagttacctatctgcgaggaatcacaagggtgccccacaaaagagatgtactggaatatggctctaggtgccctctcgcgggtctaaacccgcgcgagaacccacggtacaggatatgaacaagagggaagggaattcaccttggatccgcccaccaaaaaattcttactaatggtctcctccgcacctattcgaagaaactgtgcaaatatgcaatcttgtagaggggactgttatctaacgttttctgtgcgcaaaacatacctgggcaatcccgtatacaccagcgaaacaggcctgaatttgaaattttgagggagaccacaaaattgggttatggcgcctggaggagcgatttttccatggttaaacataggggg

SEQ ID NO: 87412 - protein, 119 aa, Zea mays
  misc_feature: Ceres CLONE 1574464
MEANPKNTFTMKVEDRKPGKDGRLAVGPVFPSVLAKDGFPQLEPDMNTSWDVFKVAPVKYADNRMLGGGACIDGPPPPLLVEIIQGDLRRRCLHAGLCVGRNLRSSNLGFPGVGDLTGR

SEQ ID NO: 87413 - DNA, 1243 bp, Zea mays
  misc_feature: Ceres CLONE 1574466
  misc_feature: Encodes the peptide sequence at SEQ ID NO. 87414
  misc_feature (1)..(1): n is a, c, t, g, unknown, or other
ngtttgtgttgttttttttttattttataggagagcaatccctgactcaattaaaatataattttgtggtggcgtggcaaaactggtactccccgcggtggcggccgctctaaactagtggatcccccgggctgcatgaattcgtctcacccctagaaaaaaacagtgtgcactgtctctcccatgctttctcttggtaggtgttctctgcctgcctcctccaaccccggcccctcactagaattcttgtcgcaagcacacaccatgatctgttacatgctgtggttagcggcatgctacctcctcctcttgtacagcgttcgattcatgtccggctggagccatggctacagccccatgagctaccccgagaattgggtgcctggtctacttctacaagaaccggtggcagctgcatgactggaactctgagatgatggctccttagctcgacacaatacgatcactggttgactcgtttggcccccctgtgcattgtttttgtaccattgaacctctctgtaaaattcaaacatatttccctacaatcaaacaattattcaattatcccgctaggggggaaaagtcccttttgtcccttacttattatatctttgctaaccttaaatgtagactacccaaaaaattcttatctaccccttttatactgtgctgacactctagtcggaggcagactcccccgtaactgataatatctcggtgcatttaaatacacaccctattgattttacattctctagaaacgaaattctccatataatatctctatatgcgaagtagaatatatgagaaaatataggtgtaccctcctatacactaactcattcttgatatgtgttcttcctatagtagtttactacatacacgaacaaagcacggtcacaaaattagaaagtgagagctatagtaacacccattatgatgatctctcttgtaccacctattcatggatgaaactccacactgtgagacacacgcggtcggcgaaaggttaaaaaaaactttcttcaatatgaaacctacatggtttcaccgatggcgggactgtaaactcaaatagtttagaacgatatgagataaatgttgggcgtcaactggtgtctgttcctccgcttgggcgcgttttttgtaaccaaccaccaatataacaattcatagttatatccaacacaacatagagcacagagagagaaaatagaaacgttggtgacgcatgatccaa

SEQ ID NO: 87414 - protein, 51 aa, Zea mays
  misc_feature: Ceres CLONE 1574466
MICYMLWLAACYLLLLYSVRFMSGWSHGYSPMSYPENWVPGLLLQEPVAAA

SEQ ID NO: 87415 - DNA, 838 bp, Zea mays
  misc_feature: Ceres CLONE 1574468
  misc_feature: Encodes the peptide sequence at SEQ ID NO. 87416
ctggagctccccgcggtggcggccgctctagaactagtggatcccccgggctgcaggaattcgtctcacccctagaaaaagtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggctcagggaggcataaatgctgcacttggaaacatgagtgaagatgactggaggtggcatatgtatgacactgttaagggaagcgattggctgggtgaccaggattctattcagtatatgtgcagagaggcaccaaaagctgttatagagcttgagaactatggactaccattttcaagaactgaagagggaaagatataccaacgtgcctttggagggcagaagctagattttggcaaggtggacaagcctaccgttgtgcctgcgcctgctgacagaacaggaaatgcctatgctggcacaccctattttgggccaagcaatgaaagccccaaccctccaatttttttggggggaaaacttttgccttttggacccttctccctggggccaatggaagaggaaaaattgtgccgggggaaatcctggtgcccctt

SEQ ID NO: 87416 - protein, 220 aa, Zea mays
  misc_feature: Ceres CLONE 1574468
  misc_feature: SWISSPROT Homolog: EC 1.3.5.1 Succinate dehydrogenase (ubiquinone)
MWRSCVSRGLSRAKASASRLLSTASSSYTVVDHTYDAVVVGAGGAGLRAAIGLSEHGFNTACITKLFPTRSHTVAAQGGINAALGNMSEDDWRWHMYDTVKGSDWLGDQDSIQYMCREAPKAVIELENYGLPFSRTEEGKIYQRAFGGQKLDFGKVDKPTVVPAPADRTGNAYAGTPYFGPSNESPNPPIFLGGKLLPFGPFSLGPMEEEKLCRGKSWCP

SEQ ID NO: 87417 - DNA, 958 bp, Zea mays
  misc_feature: Ceres CLONE 1574473
  misc_feature: Encodes the peptide sequence at SEQ ID NO. 87418
  misc_feature (1)..(1): n is a, c, t, g, unknown, or other
  misc_feature (908)..(908): n is a, c, t, g, unknown, or other
  misc_feature (958)..(958): n is a, c, t, g, unknown, or other
natagctggagctccccgcggtggcggccgctctagaatagtggatcccccgggctgctggaattcgtctcacccctagaaaaaacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagaccgactgcgtgctgaagctcctgcatgccggcgccaatatcctcatgttcgactcccagcacgggcggacctgcctgcaccacgcgtcctacttcggccacgtcggctgcctgcaggccatcctcacggcggcgcggaccacgccggtggccaactcatggggtttcgctcggttcgtcaacgtgagagacgaccacagggccacgccgcttcaactcggcgtctaggaagggccgccccggctgcctgcaagcgctgctggaaaacagtgccatcgttctccgctttgaccggcgtcatcggggtttccgggtagcaggttgctgcacctccgcgttcccaacgggagcctggattgcaccccgaaacttcctcnctggggggagcgagacgcctcccggagggattctcgcacggaggtaatcn

SEQ ID NO: 87418 - protein, 167 aa, Zea mays
  misc_feature: Ceres CLONE 1574473
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGVSCARTGDEHDYFRAAQVGDLEALEALLDADPSLARRATLYDRLSALHIAAANGRLEVLSMVLDHGVPPDVVNRHKQTPLMLAAMHGKTDCVLKLLHAGANILMFDSQHGRTCLHHASYFGHVGCLQAILTAARTTPVANSWGFARFVNVRDDHRATPLQLGV

SEQ ID NO: 87419 - DNA, 929 bp, Zea mays
  misc_feature: Ceres CLONE 1574474
  misc_feature: Encodes the peptide sequence at SEQ ID NO. 87420
ctccccgcggtggcggccgctctataactagtggatcccccgggctgcaggaattcgtctcacccctagaaaaagtccctctccctagtccctcccctcgtccgtcgtccacctctgccactacgagctcgtccccgtcttgtttcgtctcctctcgtctcgtcacgcgagatatttctacgggacgggacccgcgttgcttccccgcctcgccgtcccgcgcgcgccagccgggcccggggaagccatgaactgcctccagaacctgctcaaggagcctcctatcgtggggtccaggtcgatgaggcggccctctccgctgaatctggcgatggtccgcggcggcagtctcctatcaaacaccgtcaaaactttgcaggcccctggggcgtccacttccggtgccgagagcagcgccgtggagatgggcaccgagaagtccgaagtgtacagcactaacatgacgcatgctatgggagcagcgttgacatatagacatgaactcgggatgaactactatttcatacgcccagacttgattgtaggatcctgcttacagagtccacttgatgttgataagcttcggaagattggtgtcaaaactgtattctgcttgcagcaagattcagatcttgagtatccccactaacattttgtaacgcgtctcttatagctagtctactgatttggctaaactctcgatagcttctttctcgttttctttggtcccgcttgtaatctctttctttcacttcaaaagtttcaataaatcgcgctgtaggggtttccctacagcactctcccctcaaaaaaattttgtaacacatatcagcttactatatgaatctttgtatctggagcatcaattttagacaccgtgtagggctcaacttgctagacagacagcttggttgcatttgtcagtaatc

SEQ ID NO: 87420 - protein, 133 aa, Zea mays
  misc_feature: Ceres CLONE 1574474
MNCLQNLLKEPPIVGSRSMRRPSPLNLAMVRGGSLLSNTVKTLQAPGASTSGAESSAVEMGTEKSEVYSTNMTHAMGAALTYRHELGMNYYFIRPDLIVGSCLQSPLDVDKLRKIGVKTVFCLQQDSDLEYPH

SEQ ID NO: 87421 - DNA, 953 bp, Zea mays
  misc_feature: Ceres CLONE 1574475
  misc_feature: Encodes the peptide sequence at SEQ ID NO. 87422
  misc_feature (858)..(858): n is a, c, t, g, unknown, or other
  misc_feature (859)..(859): n is a, c, t, g, unknown, or other
  misc_feature (930)..(930): n is a, c, t, g, unknown, or other
ctggagctcaccgcggtggcggccgctctagaatagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgacaacctgatcgggacgctgacggtgcgcgagacgatcggctactcggcgctgctgcggctgccggaacagatgccgcgggaagacagcgcgcgctggttgaaggcaccatcgtcgagatggggctgcaagactgcgccgacaccgtcatcggctactggcaccnntcgcgggtcagcggcgggagaaagcgcgcgtcagcatgcgctcgagctatcatgcggccgcgctcctcttnctcgaggagccacagcgggctct

SEQ ID NO: 87422 - protein, 245 aa, Zea mays
  misc_feature: Ceres CLONE 1574475
  misc_feature: SWISSPROT Homolog: EC 3.6.3.28 Phosphonate-transporting ATPase
  misc_feature (214)..(214): Xaa is any aa, unknown, or other
  misc_feature (238)..(238): Xaa is any aa, unknown, or other
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNGRKAKLSFGAAAYVTQDDNLIGTLTVRETIGYSALLRLPEQMPREDSARWLKAPSSRWGCKTAPTPSSATGTXRGSAAGESARQHALELSCGRAPLXRGATAGS

SEQ ID NO: 87423 - DNA, 940 bp, Zea mays
  misc_feature: Ceres CLONE 1574476
  misc_feature: Encodes the peptide sequence at SEQ ID NO. 87424
  misc_feature (789)..(789): n is a, c, t, g, unknown, or other
ctggagctccccgcggtggcggccgctctagaactagtggatcccccgggctgcaggaattcgtctcacccctagaaaaagttcctccgcttcctctgtctctgtctcgtcgtctcccccatctggccatctccggctagggtttgccctcccaccacgtccgaggtctagctcgtctccgccactgccggaccaaggatgtcgcaagagcaaggtatggaggagccgccgccgcaggcggtaggcgaggcacaatcggccgccgatgtccccatgagcgaggccgcagcggtggaggatgaggatgaggaacccgtcatgggggaggggcagggcggtgaaagcgggaccgccgatgccgttgattccgtcaaggcttcagtgaagcccgaagcagagggcgcggaggaaggggacagagaggagcttaatggtggcccgacggcggatttgactgacgaggttgtgaaattggagaacggggatggccccgtgccggtgggtggctccgcggatgagtgcggagctggagatggcggtgttgataagggcctggttggtcagaatgagcctgttgtgaaccagcttgtgctggtgcaggctgaggaggagctggcattgtctaagatctcaaacagttccttcatgttcgattacaccactgggggtgatgactcagggactgaggaggagcaggctgccttcatgaaggagctggagcgtttccacagggagaaaatgttggagttcagccccctaagttttatggtggaggattgaattgcctcnaattgtggagacaagttactggattggggtggctatgatcaggtgacatcatgcaagctgtggcgtcaagtgggagagtcattcaaacctcaaagacatgtacaactgtttcatggactttcccgtaactctatgagaaagcactccctgg

SEQ ID NO: 87424 - protein, 193 aa, Zea mays
  misc_feature: Ceres CLONE 1574476
MSQEQGMEEPPPQAVGEAQSAADVPMSEAAAVEDEDEEPVMGEGQGGESGTADAVDSVKASVKPEAEGAEEGDREELNGGPTADLTDEVVKLENGDGPVPVGGSADECGAGDGGVDKGLVGQNEPVVNQLVLVQAEEELALSKISNSSFMFDYTTGGDDSGTEEEQAAFMKELERFHREKMLEFSPLSFMVED

SEQ ID NO: 87425 - DNA, 902 bp, Zea mays
  misc_feature: Ceres CLONE 1574478
  misc_feature: Encodes the peptide sequence at SEQ ID NO. 87426
acccgcggtggcggccgctctagaactagtggatcccccgggctgcaggaattcgtctcacccctagaaaaaccaatccaatccctacctgcccgggaaccacccgtcgggctcctcccgccctcctcgccgcatctgcatgcggcggggatctccgggctcgctccagccccaatcaccgccacctcatccaagcccccgaatcccccgggcgcgcgcagcacaaccttgccgcgatcgcgcgcgggaaccgccgctgattgggtcgtgaaagctcgattttggcgattttgattcggagaacccgccgtcattcgattttggcgcgcgttgcgagccgggatggggttgcagcagtccaaagaggaactgctgtaccagcaggtcaactacggcaacgtcgacgggattcgcacgctccgggggcaaggcgctggtctcgagtggattgacaaggaaggcaagacgcccctgatgcttgcctgtatgcgcccggatctgttcgacgtggccaaggtgctgatcgagttgggagctaatgtgaatgcctacaggcctgggtcacactgtgggacagcattgcaccatgctgccaagaaaggacttcagcagactgtccatttactactctcacatggagctaatccgttcataccaaacgatgattgcaatactgccctcgaattggcaagagaaaagggtcatgtgaatgttgtacgtgccatagagggacggctttgtcttttttgcggatggatgagagagactatgcctctgctttttttgatgcaattgctcaccagtcatgacaagaaaatttgggctggtggttttaccccgtgaagtgcgactccaacaggcctcttaagttagagaaggatatatcccgaataaagcatcca

SEQ ID NO: 87426 - protein, 166 aa, Zea mays
  misc_feature: Ceres CLONE 1574478
  misc_feature (75)..(107): Pfam Name: Ank Pfam Description: Ankyrin repeat
  misc_feature (39)..(72): Pfam Name: Ank Pfam Description: Ankyrin repeat
  misc_feature: SWISSPROT Homolog: EC 2.1.1.43 Histone-lysine N-methyltransferase
MGLQQSKEELLYQQVNYGNVDGIRTLRGQGAGLEWIDKEGKTPLMLACMRPDLFDVAKVLIELGANVNAYRPGSHCGTALHHAAKKGLQQTVHLLLSHGANPFIPNDDCNTALELAREKGHVNVVRAIEGRLCLFCGWMRETMPLLFLMQLLTSHDKKIWAGGFTP

SEQ ID NO: 87427 - DNA, 952 bp, Zea mays
  misc_feature: Ceres CLONE 1574480
  misc_feature (740)..(740): n is a, c, t, g, unknown, or other
ggagctccccgcggtggcggccgctctagaactagtggatcccccgggctgcaggaattcgtctcacccctagaaaaataacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctggggttagaccgtcgtgagacaggttagttttaccctactgatgaccgcgccgcgatagtaattcaacctagtacgagaggaaccgttgattcacacaattggtcatcgcgcttggttgataagccagtggcgcgaagctaccgtgtgccggaatatgactgaacgcctcttagtcagaatccaagctagctaccggggcctctgctcgncgcccgtcccgtaccacgttagggcgttcgcgccccaagggcccgtgccattggctcagcccgccaggtctaagcgcccggtcggccgcctcgtagctcccttccaacgggcgcgtgctgaatctttgcagacaacctaaaccccacggggcattgtagtgggcaaatgggcttgctgcacgaatccctgagatccagcccccgtcgcaggg

SEQ ID NO: 87428 - DNA, 956 bp, Zea mays
  misc_feature: Ceres CLONE 1574481
  misc_feature: Encodes the peptide sequence at SEQ ID NO. 87429
  misc_feature (816)..(816): n is a, c, t, g, unknown, or other
  misc_feature (907)..(907): n is a, c, t, g, unknown, or other
  misc_feature (944)..(944): n is a, c, t, g, unknown, or other
agctccccgcggtggcggccgctctagaactagtggatcccccgggctgcaggaattcgtctcacccctagaaaaagcaaaaacttgcttccttcgacggccgcatcagtcttccacgtacgtcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtccgtggtggcggagctggagggtgcgctgcttcggagcgcggacacgctcccgtacttcatgctcgtggcgttcgaggcgtccgggctgccgcgcttcgcgctgctgctggcgctgtgcccgctgctgcggctgctagagctggcgggccgtcgcggcctggcgctgcgcgccgccgcgttcgtggccaccgcgggggtgacacgcgccgagctggaggccgtgtcccgcgccgtgctgcccaagttcatggccgacgacgtcgaccccgcggcctgggcggccttcgggagctgcgaggggaggcgcgtcgtcgtcacgcggatgccccgcgtcatggtcgagcgcttcgccaaggagcacctcggcgcgcacgccgtggtcggctctgacctcgagtacagccggctcaggcgctccacggggctcctcaaaggcgcctgccacgagaccgtcgccagccgtgtccgcgcgctgttcgccggcgacgacctgccgggacctcgcgatcgccggctcagagatggcgcgctccttcacattctgcgaggagcncctcagcccgccgttcactgggagacacgggatgaacgccggcccacggttccgggcggtcatcttccacgaacggtcgcctcgtgtgccnggccaacgcattcatgtctctcgtcatcctccctggntggcttctgggg

SEQ ID NO: 87429 - protein, 245 aa, Zea mays
  misc_feature: Ceres CLONE 1574481
  misc_feature: SWISSPROT Homolog: EC 2.3.1.15 Glycerol-3-phosphate O-acyltransferase
  misc_feature (230)..(230): Xaa is any aa, unknown, or other
  misc_feature (242)..(242): Xaa is any aa, unknown, or other
MTPASQAAPPRARRSVVAELEGALLRSADTLPYFMLVAFEASGLPRFALLLALCPLLRLLELAGRRGLALRAAAFVATAGVTRAELEAVSRAVLPKFMADDVDPAAWAAFGSCEGRRVVVTRMPRVMVERFAKEHLGAHAVVGSDLEYSRLRRSTGLLKGACHETVASRVRALFAGDDLPGPRDRRLRDGALLHILRGAPQPAVHWETRDERRPTVPGGHLPRTVASCAXPTHSCLSSSSLXGFW

SEQ ID NO: 87430 - DNA, 941 bp, Zea mays
  misc_feature: Ceres CLONE 1574485
  misc_feature: Translation starting site: 134
  misc_feature (935)..(935): n is a, c, t, g, unknown, or other
ggagctccccgcggtggcggccgctctagaactagtggatcccccgggctgcaggaattcgtctcacccctagaaaaaaccattcccttccctctcgcgagctcagatcacgcgaagcaaggaaaaaagaaaaatggcgcagctggtggagacgtacgcgtgctcgccggccacggaacgcggccgtggaatcctcctggccggggaccccaagacagacacgatcgcctactgcaccggccgcagcgttatcatccgccgcctcgatgcgcctctcgacgcttgggcctaccccgaccacgcctaccccacgaccgtcgcccgcttctcccccaacggcgagtgggtcgcctccgccgacgcctccggctgcgtccgcgtctggggccgctacggtgaccgcgctctcaaggccgagtttcggcccctctcgggacgcgtcgacgacctccgctggtcccccgacggcctacgcatcgtcgtctctggggacggcaagggcaagtccttcgtccgcgcatttgtgtgggactctggcagcactgttggtgaatttgatgggcactcaaagagggttctgagctgtgacttcaaaccaacacgtccatttcgcattgtgacatgtgggtgagattttctggctaacttctatgaaggaccacattcaaatttaagcattcccataaggatcactcaaattttgttaactgtatccggtatgctcctgaatggtagtaagttaatcactgtgagttctgaatagaaggttttgatatatgaatgcaaaactggagaaaaataggagaacttccactgaaggcatcatacagggagcattatgcctgttagctggagtcctgacagtaaacaggttctacagtttctgctgataatctgcaaagttggggattcatggagaatgcagtgggaaatgnatcgac

SEQ ID NO: 87431 - DNA, 930 bp, Zea mays
  misc_feature: Ceres CLONE 1574486
  misc_feature: Encodes the peptide sequence at SEQ ID NO. 87432
  misc_feature (871)..(871): n is a, c, t, g, unknown, or other
  misc_feature (872)..(872): n is a, c, t, g, unknown, or other
ctccccgcggtggcggccgctctagaactagtggatcccccgggctgcaggaattcgtctcacccctagaaaaagttccccaggcgcagcagcacggcagtcctccgtttcctcctcgtcgctcgccccggttgtctcctcctcgacctcccccgtcgcgacaccgcccgatctctctagcgcacggcggccggagaagaggaggagggggggacgatctcattcatcggaccggcgtgcctgtgtcgtctgctgttttcgtttttttctttactcttttttttccctcctttgcttgttcaattcaatcagtatattaagatttctgatttgggggcggctcgccatgggattcggaatggggaataataacaacggggcgagctcctcgtcgtcgcgcctggacccggcgttcgccgctgctgccgcgccacggcagcagcgggggccgcgagggtggtggcctgtcctcgcagccgaagacgttcgccaacgtcttcatcgcggtggtcggcgccggcgtgctggggctgccgtacaccttctcgcgcaccgggtgggcggcggggtcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcacgggcgggtcgccgtggacgtgatgctggtgctcagccaattcagcttctgcgtcggctacctcatcttcatctccaacacatgtcgcacctctatcgatttacgccgggggtcctaattctcgggctcctctccccagggggtcgtcatctgggcgatgctgcnnttcagctcgggctcactccatcaagaactgacctgcttggccgctagaatcttcgcga

SEQ ID NO: 87432 - protein, 70 aa, Zea mays
  misc_feature: Ceres CLONE 1574486
MMLLVACRRRLADEHPKIASFGDLGDAVFGAHGRVAVDVMLVLSQFSFCVGYLIFISNTCRTSIDLRRGS

SEQ ID NO: 87433 - DNA, 944 bp, Zea mays
  misc_feature: Ceres CLONE 1574487
  misc_feature: Encodes the peptide sequence at SEQ ID NO. 87434
  misc_feature (873)..(873): n is a, c, t, g, unknown, or other
  misc_feature (912)..(912): n is a, c, t, g, unknown, or other
agctccccgcggtggcggccgctctagaactagtggatcccccgggctgcaggaattcgtctcacccctagaaaaaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatgacattggggtgatgagtggagcggccatgtacatcaagaaggacctgaatatcacggacgtgcagctggaggtcctgatcgggatcctcagtctctactcgctgttcggatccttcgctggcgcgcggacgtccgacaggatcggacgccgcttgaccgtcgtgttcgccgctgtcatcttcttcgtgggctcgttgctcatgggtttcgccgtcaactacggcatgctcatggcgggccgcttcgtggccggagtcggtgtgggctacgggggcatgatcgcgcccgtgtacacggccgagatctcgcctgcggcgtcccgtggcttcctgaccaccttcccggaggtgttcatcaacatcggcatcctgcttggctacctgtccaacttcgcgttcgcgcgcctcccgctccacctcggctggcgcgtcatgctcgccattggcgcagttccgtccggcctgctcgcgctcctggtgttctgcatgcccgagtcgcctcggtggctgggtctgaaaggccgcctcgcggacgccagggctgtgctagagagacctctgccacgcagaagaagccgccgtagcgctgggcgactcaagggccgcgcggggattccgaaggcctcnacggggacgtggtcacgtacccaacagagcaagggcgcngttgattgcaaggtggaaacagctcatctgtc

SEQ ID NO: 87434 - protein, 269 aa, Zea mays
  misc_feature: Ceres CLONE 1574487
  misc_feature (24)..(269): Pfam Name: Sugar_tr Pfam Description: Sugar (and other) transporter
MASDELAKAVEPRKKGNVKYASICAILASMASVILGYDIGVMSGAAMYIKKDLNITDVQLEVLIGILSLYSLFGSFAGARTSDRIGRRLTVVFAAVIFFVGSLLMGFAVNYGMLMAGRFVAGVGVGYGGMIAPVYTAEISPAASRGFLTTFPEVFINIGILLGYLSNFAFARLPLHLGWRVMLAIGAVPSGLLALLVFCMPESPRWLGLKGRLADARAVLERPLPRRRSRRSAGRLKGRAGIPKASTGTWSRTQQSKGAVDCKVETAHL

SEQ ID NO: 87435 - DNA, 942 bp, Zea mays
  misc_feature: Ceres CLONE 1574488
  misc_feature: Encodes the peptide sequence at SEQ ID NO. 87436
  misc_feature (494)..(494): n is a, c, t, g, unknown, or other
ctcctcggtggcggccgctctagaactagtggatcccccgggctgcaggaattcgtctcacccctagaaaaaaaaattccccatttttacggacaccagcaagccacgccacactcccaatcgccgcagcagctggtcccctgctcggctcgtctgatccagcggctgaatccacaggccatggggttcgacaaggaggcgagctcctcctcctcgcggctcgacgcggcgccgctgctcccgcagcacggcggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgccggatcgcggacgcgcaccccaagatcgcctccttcggggactgggncacgccatctacggcgcgcccgggcgcccacgcgtcgacgccatgctcgtgctcagccaggccaggctctgcgtcggctacctgatcttcattctccacaacagggggcacctctaccccatcggcatcgggggccagttcccgggggttcccgcttcctacgggcaaaggcgctcctttttctgggcatgttggcgttccagttcggcctcaaatccttaaggaagctccagctccttgggcccttaaaattttttgccaaattttttaacccgggcccctggggcttttcctggggaaagaaaccccctttgggttccccaaaaggccccccggtttcccttttttgtgtccccccaactcccttgagggctgggggggcgcgttaacccctttaggagaaccaatgattcccccccccgggggggagagccccaaaaagagtggg

SEQ ID NO: 87436 - protein, 132 aa, Zea mays
  misc_feature: Ceres CLONE 1574488
  misc_feature (105)..(105): Xaa is any aa, unknown, or other
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDWXTPSTARPGAHASTPCSCSARPGSASAT

SEQ ID NO: 87437 - DNA, 929 bp, Zea mays
  misc_feature: Ceres CLONE 1574490
  misc_feature: Encodes the peptide sequence at SEQ ID NO. 87438
ctccccgcggtggcggccgctctagaactagtggatcccccgggctgcaggaattcgtctcacccctagaaaaaaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatggcggtgatggccgaagtagtctcgaccaccggcgcggcgctccggagcccggcctcgcagccgctgccggccgcggtgaagaacgcagacgctgagaagctccagttcatcgaggagatgacctccaacgtggacgccgtgcaggagcgcgtgctgggggagatcctcgcccgcaacgccggcaccgagtacctcgccaagtacggcctcgccgccgctactacggaccgcgccaccttccgcgccaaggtgccgatggcgacgtacgaggacctgcagccgtacatccgccgcattgccgacggcgaccgctcgcccatcctgtcggggcacccggtctccgagttcctcaccagctccggcacgtccgccggcgagcgcaagctcatgcccaccatcgaggacgagctcaaacggccgccagctggctgtacagcctcccaaatgccgttaatgaacctgtacgtgcccgggaatggacaaagggaaaggccctccattttctccttccccaggcgggaaaacataaaccccggggggggttcccggggagaggcccgtccggacgaagttcttaaaggaagaaaccctttcagaaaccccccggttgaaagcttaaaaaaccaaccgaaggcccacgggtgtgcattttttttgcgccgaccccgttccaaaaaatgtatccgcccaaatgggtgggg

SEQ ID NO: 87438 - protein, 234 aa, Zea mays
  misc_feature: Ceres CLONE 1574490
  misc_feature (33)..(233): Pfam Name: GH3 Pfam Description: GH3 auxin-responsive promoter
MAVMAEVVSTTGAALRSPASQPLPAAVKNADAEKLQFIEEMTSNVDAVQERVLGEILARNAGTEYLAKYGLAAATTDRATFRAKVPMATYEDLQPYIRRIADGDRSPILSGHPVSEFLTSSGTSAGERKLMPTIEDELKRPPAGCTASQMPLMNLYVPGNGQRERPSIFSFPRRENINPGGGSRGEARPDEVLKGRNPFRNPPVESLKNQPKAHGCAFFLRRPRSKKCIRPNGW

SEQ ID NO: 87439 - DNA, 972 bp, Zea mays
  misc_feature: Ceres CLONE 1574491
  misc_feature: Encodes the peptide sequence at SEQ ID NO. 87440
gctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggacgctcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagagggcaggccacaaaagatgccgggggtgattgctggcctttattgtgctgcgtatcatcaacgagccaacagctgcaactttcgccttatgtctttgacaagaaggctaccaggtgtcggggagaagaatggccccatctttgatcttgggaggtggtacctttgaagtcctccctcctcccccttgaagaaaggaatctctggaagggcaaggcccccgcctggtgaacaccccatcctgggtggtggggggacttggacaaccaggatggggcaaacccctttctcccaggaagttcttggagggaaaacaccggaagggtattcccggg

SEQ ID NO: 87440 - protein, 167 aa, Zea mays
  misc_feature: Ceres CLONE 1574491
  misc_feature (9)..(167): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRTLSDASVQSDIKLWPFKVISGPGEKPMIVVQHKGEEKQFAAEEISSMVLIKMREIAEAYLGSTIKNAVVTVPAYFNDSQRAGHKRCRG

SEQ ID NO: 87441 - DNA, 929 bp, Zea mays
  misc_feature: Ceres CLONE 1574494
  misc_feature: Encodes the peptide sequence at SEQ ID NO. 87442
acccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaacacctgcattttcattttgatctccctaatccctcccgctagctgctttccagtgacaaaagatatcaaagaccacttcccgtcctcctcccgtggctgtctgtcatctggctctgaaacgatggcagtcctggcagttgctgctgctgcccctccccctgtttttgtgattgggttcagggattttgagaaccccttggaaacaccttccccgaaggaactgtcttggctgaccccagggaaggggactggtggcccttcccggggcccaataaacctgttcttgaacttgtccggggcccccttggtccaagctccaaggggaactccaaccttttgtcttttgggggaagccgttttgttcccccaaaaaatttggttcaaaaccggggaaaaaaaagtttttggcccttttcagagaatctttatttt

SEQ ID NO: 87442 - protein, 51 aa, Zea mays; identical to SEQ ID NO: 13325
  misc_feature: Ceres CLONE 1574494
  misc_feature (1)..(51): Pfam Name: AdoMetDC_leader Pfam Description: S-adenosyl-l-methionine decarboxylase leader peptide

SEQ ID NO: 87443 - DNA, 1108 bp, Zea mays
  misc_feature: Ceres CLONE 1574497
  misc_feature (1108)..(1108): n is a, c, t, g, unknown, or other
catagctggagctccccgcggtggcggccgctctagaactagtggatcccccgggctgcaggaattcgtctcacccctagaaaaaacgcgtccactgtcgatccacacgcaaggctgcaggtctcaacccccgctcggacgggcaggcgcacgaccttttccttgctgccgccgccagtacgagaccgaggagggatcccccgctctcacgccgctccatgccaagagcacaggtagaaggtgaacaccttcttcctcttctgcgcgtgcgtgtaccaggcacatctccgcggacgtggagaagaagctgcacttcctccacctgctcaacacgggccacaacttcttcatgcccctcaacggggagtacctcgcgcgctccctctcctcactggtccagcccccccacccctccaacgacgacgacaccgacacgctcacgcccgtcgagccctcgcggtgcaatatttgcttagttgctcggcgccggctatggtgcctcctcctggtgcttctactgtctgccgctgttggtgctcttcgatcctaccacttcggtccccgctcaggccatcctagccggtcatggcccattcggccaccggcttcccaaactgggcaccctggctagccttgttaccaccaatattaactatagaacccctgttttggccttggcaagctaggtctcctaatttgtcgaagttccgttaccccggactgtgcctatttccccattccgcgcaaacatcttggccccctggcctctttggtttctatgttttgaaaacctaattcttaattttgcttaccacattcggatgtttaccgcaacttagtaacttgttaaacgaacagacgctcttctataaccgctcccacatgccccactaggtttatacggaaatcactatcaatggatgagggcggaatcatgtatctcgcgttttcctcgttatcccacctcccccccacttgcttaatataaatatgcccatgttcatactataaagtccggtgtgggttccgcaaaaatacagtgggtcaacctatttatcgacctccactagtggatccgtcttcaccctgattgtgcgactttgttccn

SEQ ID NO: 87444 - DNA, 922 bp, Zea mays
  misc_feature: Ceres CLONE 1574505
  misc_feature: Encodes the peptide sequence at SEQ ID NO. 87445
ctggagctccccgcggtggcggccgctctagaactagtggatcccccgggctgcaggaattcgtctcacccctagaaaaaaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgccccgcgctgtcgggagcagccggagcgctgccgcgaggctgctgctgctcccgcctctccggctgcgccgcggccggcgcgccgcctccgcgtgcgcggtgagggcgggcctgcacgggctcgactccgtcggcgggccccatctccaggccgcgctggagcgcgccgaggcggcgctctacacgctcgccgacgcagcggtagccgcggcggacgccgccgcgggcgcgggggacgacgccggccaagctgcggcggcggtccagaagaacggcggttggttcggcttcatctccgaggccctcgaggtcgttctcaaggtgctcaaggatggtctctcagcagttcatgtgccgtactcctacggatttgccatcattcttcttactatcatttgtaaggctgcgacatttgccttaaccaaaaagcaggtggaatcaactctggcaatgcaagaattacaagcgcagctttaagcaatccagcagaaatatgcggggcaccaagaaaggatacagctagagactgctcggttatacaggcaagcttggggtcacccttttagcaagaatgtttccaacttgggaacattacccgttatggatgggcctttt

SEQ ID NO: 87445 - protein, 172 aa, Zea mays
  misc_feature: Ceres CLONE 1574505
MAKALLYSSLLPGLPRAVGSSRSAAARLLLLPPLRLRRGRRAASACAVRAGLHGLDSVGGPHLQAALERAEAALYTLADAAVAAADAAAGAGDDAGQAAAAVQKNGGWFGFISEALEVVLKVLKDGLSAVHVPYSYGFAIILLTIICKAATFALTKKQVESTLAMQELQAQL

SEQ ID NO: 87446 - DNA, 902 bp, Zea mays
  misc_feature: Ceres CLONE 1574508
  misc_feature: Encodes the peptide sequence at SEQ ID NO. 87447
ggagctccccgcggtggcggccgctctagaactagtggatcccccgggctgcaggaattcgtctcacccctagaaaaaagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcccctcggcgagcagggagaagaaccgagtgggtgacggtgaagttcggctggaaagagccgtcagaagacgactggattcgcgtcttctctccgtctgattcaactcgtccggctaatgtccaaaaccctgggcaagaaaagaaaccttatttttgccaggaccccttaaggttcaggtcgcccaaatccccttggaaattaattttcctggggggaaggggaaaattccggtttagagttttttaaaaaagggggtccaaatttttccttttccccttttttcacgggggggccttaaaacccccgggggggttttccgggggtgggggagccccctttttttttttaaaacccccagagggcccccgttttcccccccccttggggaggggggggcccccccccaaaaaaaaataaggggtgttggggggaaccgcgggggtctccccccccctaaaagggggccccccctcccccgggggggggggggggcgccccctttttttcccccccccgggggaggaaagccccttctcttttaccccaatataatttttttttttttaacaacatggggaggagagagcgggg

SEQ ID NO: 87447 - protein, 89 aa, Zea mays
  misc_feature: Ceres CLONE 1574508
MAVALLAALVASAAMFMLAGTASASPAEGIQPLSKIAVHRATVEMQPSAYVRATPSLPSASREKNRVGDGEVRLERAVRRRLDSRLLSV

SEQ ID NO: 87448 - DNA, 745 bp, Zea mays
  misc_feature: Ceres CLONE 1574514
ctcccgcggtggcggccgctctgaatagtggatcccccgggctgcggaattcgtctcacccctagaaaaacccgtcccaagggtgagtcttgcgtcccaccaggcttctctcccgtcctctgtccccgatttaaggcccatgctctctcgttcctatttgtggcgattggtccggcatgcgtgctgtttgtggtagatagatctgctctgcacgtctgcgttcgtcacgtataggttggattgttcgtgtggtagcctcggccgttggtgctcattcagatcggtgcttcctgcgtcggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaagaaactacatgacccagagccttttgggcccttcgatgtctgttagcggtggcattcatgtcccagtgatgcggaccccgctcctgtgctaatgctccggctgaaaaaggagccaagaacttcctgatccatttcatgaaagggccgggttttcacctgctgttttcaaaaaatggtgctgctcccctcaagacgggtgaaaccgccttttccaaccccaaaaggaagtggtttaagtccggggaggcttccaaaaccctcaaaggggtttgtttcacccgcccaaa

SEQ ID NO: 87449 - DNA, 1059 bp, Zea mays
  misc_feature: Ceres CLONE 1574518
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (439)..(439): n is a, c, t, g, unknown, or other
  misc_feature (441)..(441): n is a, c, t, g, unknown, or other
  misc_feature (445)..(445): n is a, c, t, g, unknown, or other
ctccccgcggtggcggccgctctagaactagtggatcccccgggctgcaggaattcgtctcacccctagaaaaatgctcgctcctggggagggaagaagaggacaagcaggcactagtacgccaatgcgcgagcgtgccgacagctccagaggaggaggaagaagaggtggtggggtggaactggaagtgggatacagacaacgggcgccgaccgcgacgacaccgccgccgccgctccctcctcctcgtgctcctgctacgaagcattaacaatccatggccgcccctcctccttgtagcagttgcagttgccgtatccgcgtcaggaagcatgcgcccgccagacgagccctcccaaccgtcgcctcccttgtccgcttcctgctcctcctcnncnnctcgtgcccgcccgccctggtctcgcggcgccgcgggcgncnggcnggaaacaacccccccgcccgggcgcagcaaaagcctctttccttgccttcggggggacaagcgcccaggctttccaggagggggcatgggctccccttgcccccggaatggacaaggggactccaaccttgggcaaattcccaaaggccccgaatggggggaacgttttttcccgcgtgggtggtcgcgttctccactctcccagccccggggcttttttaacccccccccgcggtctcttttaagggcccataaatacccccccaagaaccgaggccccgcgtgtggaaagggccccccttgccctcccgaaaaacagttgtcgggcgggggccttccccaaagtggggggggggccatctcttggcccctgttctcccataataacggtggtaagaccaccggggaaagagcgggccccccgagagaggaaggtgcctttattgggtaataaatatgagctgccctaattgttgttgcccccacttccccccctgggtggtgcgggattaaggccggggggttcccccccccctgatctccccttgttgggcgtatataactggtgggtgattttagtgggccacttttacggccagtccccctgtggtagg

SEQ ID NO: 87450 - DNA, 1249 bp, Zea mays
  misc_feature: Ceres CLONE 1574519
  misc_feature: Encodes the peptide sequence at SEQ ID NO. 87451
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (333)..(333): n is a, c, t, g, unknown, or other
  misc_feature (1054)..(1054): n is a, c, t, g, unknown, or other
  misc_feature (1083)..(1083): n is a, c, t, g, unknown, or other
ctttccttttgtcctactcatctcaacccaattttagcttgacacattataannnnnnnnntnnnnnnnnncaaagctggagctccccgcggtggcggccgctctagaactagtggatcccccgggctgcaggaattcgtctcacccctagaaaaagagcggccaagctgcccaagcaaaacgctaggccaccattctgaccaccaagcgcaagcagagcacaaacacacatggccaccattccgaccaccgatactggactcggcctcagatcctcagctctcctccggacgactaggagggtcgcctgatcttgaagcgcgaggatatcanaattgggaccgccgacgcacgcagctcctcgtgcgcgcctccgccaacgagacctcctttgaccggagctccagagccgcccttcaagccggcatccagaagctcgccgccacgggcggcggttccctcggaccaagaagaccccccccggggctccgatgagtctcgaacccccacagtgaacgatagatggaacttaccatcggccctcacctattggcgcttgtctaaccccccctgagagaaaagagggggggaccatccctttggaaatacccagaaatatcgcttgccataaaaccataatgaacctgcggtctgaggtaaaatgggaaccagtcaaactagaggctacgatagcgctcctcctcagggctgaggtctccaacatgaacccgggcgggcagcagcgttagagagcatctataacattaacgacagggggtgtagacacatcctcagcgtgagagctcccgctatcacacataaagtggcaccccatctctgcacaacaaaagagtaaatagtttcttcgcagaaacacattggtcggcgccgcaagagcaaatcgctttgggaattaacaaaacaaattgccaatgcgatccgcaggatctcaaacgaggtgtagatgcggcgtgtaatatattaatagataaacttgtgtatacgcgcgccttagttgtctcgcgccgcgggaaatcgggaacacacacttgtngggtactgggatttagatacttatccccnacaatcattgatatgtgataacgacgggtgaataccattgcctgaccaagctccatcgtatcaatgtatggaatacttatgtttgaagacacgggagaaactcatcgtgctataacgcgcagccatcagtgtttgtcgttggagtccatgggataacagtgtcccg

SEQ ID NO: 87451 - protein, 36 aa, Zea mays
  misc_feature: Ceres CLONE 1574519
MNLRSEVKWEPVKLEATIALLLRAEVSNMNPGGQQR

SEQ ID NO: 87452 - DNA, 831 bp, Zea mays
  misc_feature: Ceres CLONE 1574522
  misc_feature: Encodes the peptide sequence at SEQ ID NO. 87453
ctggagctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcatgtgtgccagatttgcggcgacgacgtcggcctttgccccggcggggaccccttcgtggcgtggcacgagtgcggctttcccgttctgcggggactgcttccaataccagcgccgggagggccacccaaaacggccccccggggaagaatcgatacaagggcctcaagggcttgccacccgttgaccggggtaacaaggagaagaaaggggtccatttacccggggaaaacaattttcaagggggaacgggctttaaccttccattttggggggcaaatttcttttgcttttaggggccaattttaatttttcgggcccgggagggggggaaccctttggggggcgccccccccaaaatttttttggggtttaaaccccccttggggtgtccccccccccccccccacaagggggtaatattggtggggtttattatttccccccccccgggga

SEQ ID NO: 87453 - protein, 138 aa, Zea mays
  misc_feature: Ceres CLONE 1574522
  misc_feature: SWISSPROT Homolog: EC 2.4.1.12 Cellulose synthase (UDP-forming)
MEASAGLVAGSHNRNELVVIRRDGDPGPKPPREQNGHVCQICGDDVGLCPGGDPFVAWHECGFPVLRGLLPIPAPGGPPKTAPRGRIDTRASRACHPLTGVTRRRKGSIYPGKTIFKGERALTFHFGGQISFAFRGQF

SEQ ID NO: 87454 - DNA, 951 bp, Zea mays
  misc_feature: Ceres CLONE 1574523
  misc_feature: Encodes the peptide sequence at SEQ ID NO. 87455
  misc_feature (871)..(871): n is a, c, t, g, unknown, or other
  misc_feature (872)..(872): n is a, c, t, g, unknown, or other
ctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttcctcaaggacgatcagctggagtaccttgaggagcgtcgcctcaaggatctggtcaagaagcactctgagttcatcagctaccccatctccctgtggactgaaaagacaacagagaaggaaatttctgacgacgaagacgaggaagagaagaagatgcctgacgacggaaagggtgaggatgttgatgannagggacgagaagaaagaagaaacgcagatccaggaggtttctcatgaagtggtcatgggtcaccaagagaaagcctttg

SEQ ID NO: 87455 - protein, 256 aa, Zea mays
  misc_feature: Ceres CLONE 1574523
  misc_feature (28)..(182): Pfam Name: HATPase_c Pfam Description: Histidine kinase-, DNA gyrase B-, and HSP90-like ATPase
  misc_feature (241)..(241): Xaa is any aa, unknown, or other
  misc_feature (242)..(242): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYLEERRLKDLVKKHSEFISYPISLWTEKTTEKEISDDEDEEEKKMPDDGKGEDVDXXGREERRNADPGGFS

SEQ ID NO: 87456 - DNA, 933 bp, Zea mays
  misc_feature: Ceres CLONE 1574526
  misc_feature: Encodes the peptide sequence at SEQ ID NO. 87457
ggagctccccgcggtggcggccgctctagaactagtggatcccccgggctgcaggaattcgtctcacccctagaaaaaagtatcgcctttgcccgcacacacggctcccattccatttccgctgcctgcctctgacgcgcacccacaccacctcgcctccctcagccctccgcagctcggcctctgcttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctacctccaggacgccgacgctgccgccgcctcagcgacgtcgacgctcgccctcgccgtcgacgaccccaaccccaaccccagcgccgcagggatgacgaacggccggcgccggaagcagcgcggggcagaggacgccggagccgccggggaaagggaggaggaggccaagaaggacgggaagaagcggtccatagccaagctgctcacctcgctggcggggctggaagcggaggagcacgcctaccgcgcgggcgccggggaagcgtccaggcggggactggggctgctcgagtccaaccccgaaaccggctcgaggccacaatggactactacccccagatgggaaagcaacttctacacccccccccaagtccaaggccgccgcccaggtccaaggggccccgggttcgccgcgtctgggcccccccagaagcccatcttagggctggggaagaaggcgcaactctcactggtggtgtaattcccctccccttttgggactttccaaaaagacctgtcccgggaaatatggtcctatgatgtcctcacatcatagccgccctgtgtgggtcct

SEQ ID NO: 87457 - protein, 129 aa, Zea mays
  misc_feature: Ceres CLONE 1574526
MTNGRRRKQRGAEDAGAAGEREEEAKKDGKKRSIAKLLTSLAGLEAEEHAYRAGAGEASRRGLGLLESNPETGSRPQWTTTPRWESNFYTPPQVQGRRPGPRGPGFAASGPPQKPILGLGKKAQLSLVV

SEQ ID NO: 87458 - DNA, 1184 bp, Zea mays
  misc_feature: Ceres CLONE 1574527
  misc_feature: Encodes the peptide sequence at SEQ ID NO. 87459
  misc_feature (259)..(259): n is a, c, t, g, unknown, or other
atagcatggagctccccgcggtggcggccgctctagaactagtggatcccccgggctgcaggaattcgtctcacccctagaaaaagcactcttgggttcttgcatcccgcataccctcgaaagctagaaagatcccgcggcgcagcagccacccttctctcctctccgctcccaatcttatcgtcgcctccctcgaagtcgccgctgccttcattccaccatggcgcttcacgccccggtccacgtgatgaaggactcnctgaagcgggagtctggcgcgaaggttcccaagccaacatccaggcggccaagggtggttcctgacatcattcgcacgacattgggggcccagatccatgctggaaaatgcttctggacaccgggtggaagatttggggttaccacccaatggtaatttctatttttgagggaaaaagaacaacggcacaccccgtgttgccaaggcgtatgatttgaacctacgccgcgaccccaaaatgagcggatgttgggggaatgggccctacccccgggtccttgggttctaatctggggaaaaaaagggcctcacctgtccgccaaggggattttttttgtgttagagaattatcccccgccttcttggtttattttgcctgagacagctacacccacaagatcgcgcatggagtggaatcgggttttggcgcggtgtcgttggtccaaaaagtgtgtccaccgacccccgcttgtatacgtggaattatatatccttcgctgggctctatgttcgtttaggatcacgccgtgttaggaagtcctctccctcttggtgtggcaagaaacaatactacggtgcgccgttagtgttcggggggatctatactgtcggtgaggagtctcctgctctgtagtgatttggctccaactcccacataagtggcctccgccgttatctcgggtattgggaggttgtctcgctctgagagccgccttggacttgaacatcctttttatggtgtttgatttgagctttccgccctgggattcgcttctatagtggggcccagtctcccttccgtcgatggattctattcgcaatgtagccgcgtatgtattcgcgcctcctacaacactgctgttgtgaccaacacacgtttccacccccgattccatcttctgtgtacgtcccctgtctagtttac

SEQ ID NO: 87459 - protein, 64 aa, Zea mays
  misc_feature: Ceres CLONE 1574527
MALHAPVHVMKDSLKRESGAKVPKPTSRRPRVVPDIIRTTLGAQIHAGKCFWTPGGRFGVTTQW

SEQ ID NO: 87460 - DNA, 960 bp, Zea mays
  misc_feature: Ceres CLONE 1574529
  misc_feature (824)..(824): n is a, c, t, g, unknown, or other
  misc_feature (837)..(837): n is a, c, t, g, unknown, or other
  misc_feature (849)..(849): n is a, c, t, g, unknown, or other
  misc_feature (854)..(854): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcatcccaaagtgtaacggaagagttcgaaggtacgcttggtacggtcggacatcgtacctaaagtgcaatggcaaaagcgtgcttaactgcgagaccgacaagtcgagcaggtgcgaaagcaggacatagtgatccggtggttctgtatggaagggccatcgctcaacggataaaaggtactcttgggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctccaaaaggccaaaaaccccgtgcccggacctgtcatcgttctctcccccagcctattgcctcgtttccatggcggccaccgcctccaacccgttcccgttcccctcccgtcgctcgccggaagatagcctcttctgcgccgtctacccgatactactccccagccaccttcccgcgcccgcactccacgcctcgttccagtcccctccactctcccctctctcgcnactcgccccttgnctatctccatcntcttnccacgggatcccttcacgctcaccctcccggcggaccngggcgcccctgcgcgctttgcgcctcggcgcccgtgccccactccaacgggcgcttcgtttcgggact

SEQ ID NO: 87461 - DNA, 905 bp, Zea mays
  misc_feature: Ceres CLONE 1574532
  misc_feature: Encodes the peptide sequence at SEQ ID NO. 87462
  misc_feature (803)..(803): n is a, c, t, g, unknown, or other
  misc_feature (810)..(810): n is a, c, t, g, unknown, or other
  misc_feature (817)..(817): n is a, c, t, g, unknown, or other
ggagctccccgcggtggcggccgctctagaatagtggatcccccgggctgcaggaattcgtctcacccctagaaaaagatgaatttggtgcgggttgatggcgtcctgtcaggagtccgctatgcaatgatgggttctttgaagccgaggtgaatctttgacctgcctagtttgcgattccaaattccgagctcccaccgcttcttgatccgccgggcgccatgggcctctgctacggcaagtcggcggcggtccaggagccggcggtagcggaggagaacaacaaagccgatggcgcggcggcgggccgaggcgatggcccgccggcgtcgccggtgaaggtgcctcggacgcccaagcagcccaagttgtccttctacttgccgagcccgctcccgccctccagctacaagggctcgccggcaaactccagcgtcgcgtccacgccggcgcgcggcgggttcaagcgcccgttcctgccgccgtcgcctgccaagcacattcgtgcgctgctggcgcggcgccacggctcggtcaagcccaacgaggcgtccatctccgagggcggcgaaccagaccttgggctggacaagagcttcggctactccaggcactttgcggccaagtacgaccttggtcgagatgtggggcgcggccactttggcttcacctgcgctgccaagtgcaagaagggcgagctcaatggcgaggacgtcgccgtcaatgtcattcccaaggccaagatgactactgctattgccattgaagatgtcagacgggaaagttagaaatatgagttcttnggcaganccacacnacctagtgcagtttcatgatgcttttgaggatgaagaaaatgtatatggtttgttatggagttatgcaaaagaggtgaactgcttgat

SEQ ID NO: 87462 - protein, 188 aa, Zea mays
  misc_feature: Ceres CLONE 1574532
  misc_feature: SWISSPROT Homolog: EC 2.7.11.1 Non-specific serine/threonine protein kinase
MGLCYGKSAAVQEPAVAEENNKADGAAAGRGDGPPASPVKVPRTPKQPKLSFYLPSPLPPSSYKGSPANSSVASTPARGGFKRPFLPPSPAKHIRALLARRHGSVKPNEASISEGGEPDLGLDKSFGYSRHFAAKYDLGRDVGRGHFGFTCAAKCKKGELNGEDVAVNVIPKAKMTTAIAIEDVRRES

SEQ ID NO: 87463 - DNA, 957 bp, Zea mays
  misc_feature: Ceres CLONE 1574533
  misc_feature (838)..(838): n is a, c, t, g, unknown, or other
  misc_feature (859)..(859): n is a, c, t, g, unknown, or other
  misc_feature (860)..(860): n is a, c, t, g, unknown, or other
ctggagctccccgcggtggcggccgctctagaactagtggatcccccgggctgcaggaattcgtctcacccctagaaaaaagtatcgcctttgcccgcacacacggctcccattccatttccgctgcctgcctctgacgcgcacccacaccacctcgcctccctcagccctccgcagctcggcctctgcttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctacctccaggacgccgacgctgccgccgcctcagcgacgtcgacgctcgccctcgccgtcgacgaccccaaccccaaccccagcgccgcagggatgacgaacggccggcgccggaagcagcgcggggcagaggacgccggatccgccggggaagtgggaggaggaggccaagaaggacggcaagaagcggtccatagccaagctgctcacctcgctggcggcgctggatgcggaggagcacgccgaccgcgcgggcgccgcggacgcgtccaggcgggagctggcgctgctcgagtccaacgccgacacccgctcgcatgccaccatggactactacgccaagatggagagcagcttcgacgccaccgccgagtccgatgccgccgccatgtcctagcgctcattgctctgcgcgtctgtcgccacccgcggcgtcttgtccggtgtagaagcggcagcgtcagcggctgcgtcgcccntcgcgtcgtgctcgcgtaccnncgcgcgtggcatgggcaggtaggccacaccagcgcctgctgtgggtcagtactgtcgcgcgcgtgttggacggtgcacacgcgaattacccggagag

SEQ ID NO: 87464 - DNA, 976 bp, Zea mays
  misc_feature: Ceres CLONE 1574534
  misc_feature: Encodes the peptide sequence at SEQ ID NO. 87465
ctccccgcggtggcggccgctctagaactagtggatcccccgggctgcaggaattcttctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaagcagggcgctccgtaagcttgaagatggatgtctccagagcctacttcgtggcttacgtagcagggcagcgctcgtgcctcctcaagagatcatgccgcacgttctcgtccgcgatctggtactaccgttggccctgggggacaaatttcggttcctgtcacgctaactgctgccgcctgcgggcaaccgcgaggatcctgggggtcgcgggcattgcaagcgagatatctccaacaaggcccatctcgtcggctgttcccgttccccacttgggaacgcttaccaaaaatgaattgaaacaggggcgtcgcgccctgcaaatttatgggtggcgaaacccggcaacatttcccttacttcaaggggcgaataaacccccggttgttggaaacacaacgggttggccaaagacccgaacctgctgggggtcccaggcccctttggccgtggttttcacccccgttccagaatttctatcagagggc

SEQ ID NO: 87465 - protein, 269 aa, Zea mays
  misc_feature: Ceres CLONE 1574534
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSCRTFSSAIWYYRWPWGTNFGSCHANCCRLRATARILGVAGIASEISPTRPISSAVPVPHLGTLTKNELKQGRRALQIYGWRNPATFPLLQGANKPPVVGNTTGWPKTRTCWGSQAPLAVVFTPVPEFLSEG

SEQ ID NO: 87466 - DNA, 898 bp, Zea mays
  misc_feature: Ceres CLONE 1574535
  misc_feature (130)..(130): n is a, c, t, g, unknown, or other
  misc_feature (137)..(137): n is a, c, t, g, unknown, or other
  misc_feature (177)..(177): n is a, c, t, g, unknown, or other
  misc_feature (195)..(195): n is a, c, t, g, unknown, or other
ttgggtttatatataatataaataaaaaaaaaacataaatacttttttttaagtgagaaaccctatcgggggcgccttttggtttcaaaagctggaagctccacactcggttggtcgagccagctctagnaactagntgggaatcccccggagctgcagagaaattcgtctcacccnctagaaaaaaactcccantccccagtatcagggattagccgtaccaccctgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaaccgccgccgctccgacgtcgcccgccggccaggacaggctccctccgtctttcgtctttcttccctctcgaattccccataccgtacccaataagttttaaatttaaagtaagtaagaaatttggaaagtaaccaaatccctcctttggaaaaaacttggggccttcggccctttttccccccggggtttccggggggttcccctttttttttggcgcccttttttccctcgcgtccccccccccaatgtttttttcccccccccaaaaaaaaattctctctccccccttataatacctgtttggggcccctcttccccacactggtttaaaaaaatacccgcgccccccttttggttttatatgagaaccccccccaaaggggcgcccccccaaaaaaaggtgggggggccccttttttttttgtgccccccgaaaaaaaattttttaaaaaagaagggggttgttaaaaaattttcccccccccccaaaatatagataattatttttttccacccgggggggggg

SEQ ID NO: 87467 - DNA, 1152 bp, Zea mays
  misc_feature: Ceres CLONE 1574541
  misc_feature: Encodes the peptide sequence at SEQ ID NO. 87468
  misc_feature (277)..(277): n is a, c, t, g, unknown, or other
  misc_feature (1054)..(1054): n is a, c, t, g, unknown, or other
  misc_feature (1060)..(1060): n is a, c, t, g, unknown, or other
aaagctggagctccccgcggtggcggccgctctagaactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcancatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacacccgtcttcggtaagccgatcatcaccaatctttttgttacgtgcgctggtttatctgttttgttccaatcccattaaaaccacaggtgtttggggttgtgggggtgaggggaactaaatacgcctggtttgggtttcgttatatccctattggcaccgaactttgcaagaaccgcgtaatggggcttcatccgggccggggttcccttctcctggaacacagtcggggtgccacaaatggaacgcctatgcgttttagggccctttttacaaaggggaataatcccgggggcttccccggtcggaacaaagggccccaccgtatattccgggggtggtcaaggtcttactaggggaggcggtagcgaagaaataacaagtgtctctcgcgcggcccgagaggaagaatatcaacgcttcgctgtgagtgcccgtgagaccaacatattctaataggaagaaatggctcccgataggcttttaattctcgcgggaccccacccagtatcaagaataaccgtggttagcgtctccccgatactgccggcgcatacttttcacaaagaaacccctcagtagaggcgaggctctaccaaagagagaacccggggttatattctccccggcgcctccaaagctgatatcgnaatttnttataaggatacgctcccgcccgtcggtcatagtgtttaaggggcgttcgtcaatagatttgagcaattcacggggctataaaaaattcctc

SEQ ID NO: 87468 - protein, 72 aa, Zea mays
  misc_feature: Ceres CLONE 1574541
  misc_feature (25)..(25): Xaa is any aa, unknown, or other
MAGKGDGPAIGIDLGTTYSCVGVWXHDRVEIIANDQGNRTTPSYVAFTDSERLVGDAAKNQVAMNPINTRLR

SEQ ID NO: 87469 - DNA, 978 bp, Zea mays
  misc_feature: Ceres CLONE 1574543
  misc_feature: Encodes the peptide sequence at SEQ ID NO. 87470
  misc_feature (239)..(239): n is a, c, t, g, unknown, or other
  misc_feature (380)..(380): n is a, c, t, g, unknown, or other
  misc_feature (381)..(381): n is a, c, t, g, unknown, or other
  misc_feature (439)..(439): n is a, c, t, g, unknown, or other
  misc_feature (573)..(573): n is a, c, t, g, unknown, or other
  misc_feature (663)..(663): n is a, c, t, g, unknown, or other
  misc_feature (719)..(719): n is a, c, t, g, unknown, or other
  misc_feature (740)..(740): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (782)..(782): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
aaagctggagctccccgcggtggcggccgctctagaactagtggatcccccgggctgcaggaattcgtctcacccctagaaaaagcagcagcagcacagtcatccacactaacgaacgaactcttgctccgatcacgagctagctgaggtcgacgatggcggctgtgctgaacagcaggaagcggcgcaggcggtggtggccgtgctggtggcggcggcgctgctggcttcgtccactncggcggcgatccctgcgggcaggtggggtcgtcgctggcgccgtgcatccgtacccgacgggggaggccagcgcgctccccgcgtcgtgctgcagcggcgtcaagagcctcaacagcgcggcgcggaccagcgcggaccgnncagggcgcgtgccgctgccctcaagagcctcggcccacagcggtcaagagcgtcaacnatgggcaccgtcgccaccatcccccggcaaagtgcgggcgtctcccgtcggattcccccatcagcatggtccaccgactgggcaacagatcagctaagtttacgacgaccaagcctaatagccctaccgaacgntacacgaacgtcccgcgcggctggcacgaagtgatgaagcccagggggagaatttaaataaaagccgctggtattgccagagcagctggncatttaatttatcgatctatatatataccggtactgtagtactctattaatatggnatattatgggtggcccggcantgccgagtttcttccaaaannnaannnnnnnnnaaaaaaaanaaaaaaaggcgagagaagagagtcccctgtccacccccccagaaaacccattcgcaaaccccccgcagggaataggaaggggacggcgggtgccaagcccccaggccccgggaactacctgctgcgtacccggcgggctccgcttgctttcctcattcgtcgcaaaannnggggnnntacaccacccggcgccccc

SEQ ID NO: 87470 - protein, 126 aa, Zea mays
  misc_feature: Ceres CLONE 1574543
  misc_feature (76)..(76): Xaa is any aa, unknown, or other
  misc_feature (95)..(95): Xaa is any aa, unknown, or other
MAAVLNSRKRRRRWWPCWWRRRCWLRPLRRRSLRAGGVVAGAVHPYPTGEASALPASCCSGVKSLNSAARTSADRXGRVPLPSRASAHSGQERQXWAPSPPSPGKVRASPVGFPHQHGPPTGQQIS

SEQ ID NO: 87471 - DNA, 949 bp, Zea mays
  misc_feature: Ceres CLONE 1574546
  misc_feature: Encodes the peptide sequence at SEQ ID NO. 87472
ggccgctctagaactagtggatcccccgggctgcaggaattcgtctcacccctagaaaaaatctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggccccccccccaccaagtccgaccttgtcaacaacctcggtaccatcgccaggtccgggaccaaggagttcatggaagcccttgctgccggcgctgatgtgtccatgattggccagttcggcgtcggattctactctgcctacctcgtcgccgatagagttgtcgtgaccaccaagcacaacgatgacgagcagttcgtgtgggagtcccaagcggggcgggtcgttcactgttactcggggacccgtccaggggagcagccttggctggggctctaaagatcaacttgtttccccaaggacgatcagctgcgagtaccttggaggaaccgccccttcaggaactgggccaaaaacacctctgtgtttattatcttacccaatcctccctggggacgggataaaacaccttagaaggaaatttctgtgcgacaaatacgatgaagagaagaaacttgcttcggaatgaaaggttgagaacttcgcttggacggaagatacgaaaagagcaaatgagacctggatggtctcctggaggggcatgggcgaacaatgcaaccctatgtttgtagaac

SEQ ID NO: 87472 - protein, 174 aa, Zea mays
  misc_feature: Ceres CLONE 1574546
  misc_feature (28)..(165): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGPPPTKSDLVNNLGTIARSGTKEFMEALAAGADVSMIGQFGVGFYSAYLVADRVVVTTKHNDDEQFVWESQAGRVVHCYSGTRPGEQPWLGL

SEQ ID NO: 87473 - DNA, 777 bp, Zea mays
  misc_feature: Ceres CLONE 1574547
  misc_feature (308)..(308): n is a, c, t, g, unknown, or other
  misc_feature (526)..(526): n is a, c, t, g, unknown, or other
  misc_feature (705)..(705): n is a, c, t, g, unknown, or other
aatctggactccccgcggtggcggccgctctgaatagtggatcccccgggctgcaggattcgtctcacccctagaaaaaaaaggaaaggaaaggaaaggaaagggagaaaatttcatatagcaattgtttcgcgtataggagggagaacaaaggtcgcgttctcgaaagttcttgcccttgttgggaaaggatggcgtccgaggtggaggacaaacccgcggtgccgggcgccccgcttggtcgccattggtggcaacccacctcccccgaaggttttttccccgggcccccttgctgaacgggccgnttaaaatttccccttttttttttttcccttcccatttcccccgagaatttttggctttttcggggggcgaaaaccccctttttttgagggagggggcggggggaggatacccctctctttttcccccccccgggggggggccccttgtttgtttctcttttctttcccctcagaggcgggggggtgggggtgtgttttttttgcggggggggggtggnaccgaaaaaaaaaaacccccgcccggtttttttttttttttttttttctgggcccaaaaacaaaagaaaagcggggcccccgccccccttttttttattaaaataaaaaaagacccggcccccctcccataaagtagggggggctcccgcgcaaatattaaataaaccctcccccctcnagaatcgggggcgcgccccccccccccccctcgttttttttttttttttgtggggggggggggcgccccccc

SEQ ID NO: 87474 - DNA, 925 bp, Zea mays
  misc_feature: Ceres CLONE 1574548
  misc_feature: Encodes the peptide sequence at SEQ ID NO. 87475
ctggagctccccgcggtggcggccgctctagaactagtggatcccccgggctgcaggaattcgtctcacccctagaaaaagcaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatgacattggggtgatgagtggagcggccatgtacatcaagaaggacctgaatatcacggacgtgcagctggaggtcctgatcgggatcctcagtctctactcgctgttcggatccttcgctggcgcgcggacgtccgacaggatcggacgccgcttgaccgtcgtgttcgccgctgtcatcttcttcgtgggctcgttgctcatgggttttcgccgtcaactacggcatgctcatggcgggccgcttcgtggccggagtcggtgtgggctacgggggcatgatcgcgcccgtgtacacggccgagatctcgcctgcggcgtcccgtggcttcctgaccaccttcccggaggtgttcatcaacatcggcatcctgcttggctacctgtccaacttcgcgttcgcgcgcctcccgctccacctcggctggcgcgtcatgctcgccattggcgcagttccgtccggcctgctcgcgctcctggtgttctgcatgcccgagtcgcctcggtggctggtcttgaagggccgcctcgcggacgccagggctgtgctagagagacctctgccacgcagaagtagccgccgagcggctggccgacatcaggccgcggcgggtattccgaagggcctcgacggggacgtggtcaccgtacccacagtagcaggcggccggta

SEQ ID NO: 87475 - protein, 146 aa, Zea mays
  misc_feature: Ceres CLONE 1574548
MAGRFVAGVGVGYGGMIAPVYTAEISPAASRGFLTTFPEVFINIGILLGYLSNFAFARLPLHLGWRVMLAIGAVPSGLLALLVFCMPESPRWLVLKGRLADARAVLERPLPRRSSRRAAGRHQAAAGIPKGLDGDVVTVPTVAGGR

SEQ ID NO: 87476 - DNA, 1235 bp, Zea mays
  misc_feature: Ceres CLONE 1574550
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (66)..(66): n is a, c, t, g, unknown, or other
  misc_feature (68)..(68): n is a, c, t, g, unknown, or other
  misc_feature (71)..(71): n is a, c, t, g, unknown, or other
  misc_feature (1235)..(1235): n is a, c, t, g, unknown, or other
ccttccccttcccctcccccgtccctccttttttttcgacgcgccttacatcnnnnnnntttcctntnttntaatctggagctccccgcggtggcggccgctctagaacagtggatcccccgggctgcaggaattcgtctcacccctagaaaaaatctcctctctctctctctcacacacacacacggccaaattccgctctctgctttgtttacacaggcgacgcaagccacgcagcgcgccgccaccgcgtctgcactccgcccccgcgaagcttccggggggccctcttccttcctccgccccagccctcgagtcggtctccaccggcggcggcggcagggttccccgcccgccccggactgggtctgtccggccccgagattattaagggcaggcagaccttacttgggtttttgcctcgaaaccaatatgggcctcctccgctggccaaaaatggatccattttcaagccccccaaaaccccccgaatatgggaaccacgcccctcccggccacaaaattccatgcgttgttcattggggaaagaaagcccccacccttttagaaattcctgccctttcccccatgttttgtgttagacattttagaaatctttttaacccaaacatgttcggggtccccccccgctttaatacctccccctgggggtattgaatctcccgctcagcggcgtttctccccttgtggtcgtgtatcctccccatgtgaattacccccaagggatacattattcccccgtacctatttagctacgatcccacgcatgtctgattgtgagacatgcactatgctcctgcggtatcggatcctccacccgcctctagccccatactctctacgcattctgctcttcgagacaactccatttgtgtccctccatacttcggttttgtacaacttacgagtaattcctctctctcatttcgcacctgtgaatgtgggggtgtaccccgtttacactgatatggccgacactcttcatgtagacactgtgtctgtatctctctacgccttgttactcccgctttctacgcgtgcgtcgtttttattatattatgataccgacatttcgctatctttttgtctcttcctccttaatcgcaggtatttatttcataccatttcagacatctcggagtttatttccccccctcgtttttttctggtagtgataatatcttgatctttgtctatatcagcgtagccgcccn

SEQ ID NO: 87477 - DNA, 936 bp, Zea mays
  misc_feature: Ceres CLONE 1574551
  misc_feature: Encodes the peptide sequence at SEQ ID NO. 87478
ctccccgcggtggcggccgctctagaactagtggatcccccgggctgcaggaattcgtctcacccctagaaaaagaccaatccaatccctacctgctcgggaaccacccgtcgggctcctcccgcccccctcgccgcatctgcatgcggcggggatctccgggctcgctccgtcaccggagccccaatcaccgccacctcatccaagcccccgaatcccccgggcgcgcagcacaaccttgccgcgatcgcgcgcgggaaccgccgctgattgggtcgtgaaagctcgattttgggcgattttgattcggagaacccgccgtcattcgattttggcgcgcgttgcgagccgggatggggttgcagcagtccaaagaggaactgctgtaccagcacgtcaactacggcaacgtcgacgggattcgcacgctccgggggcaaggcgctggtctcgagtggattgacaaggaagggaagacgcccctgatgcttgcctgtatgcgcccggatctgttcgacgtggccaaggtgctgatcgagttgggagctaatgtgaatgcctacaggcctgggtcacactgtgggacagcattgcaccatgctgccaagaaaagacttcagcagactgtccatttactactctcacatggagctaatccgttcataccaaacgatgattgcaatactgccctcgatttggcaagagaaaaagggcatgtgaatgttgttcgtgccctaaagggacggctttggcttttttgtggatggaagagagagaaacatgcccctgccttttttggatgcaattgcccaccattcatgacaaaaaaattggggctgttgttttccccctgaagggcaaaaccaacaggccccttaatagaaaaagattatatcctgaataaagggtcttaaccccttctttattttactagga

SEQ ID NO: 87478 - protein, 166 aa, Zea mays
  misc_feature: Ceres CLONE 1574551
  misc_feature (75)..(107): Pfam Name: Ank Pfam Description: Ankyrin repeat
  misc_feature (39)..(72): Pfam Name: Ank Pfam Description: Ankyrin repeat
  misc_feature: SWISSPROT Homolog: EC 2.4.2.30 NAD(+) ADP-ribosyltransferase
MGLQQSKEELLYQHVNYGNVDGIRTLRGQGAGLEWIDKEGKTPLMLACMRPDLFDVAKVLIELGANVNAYRPGSHCGTALHHAAKKRLQQTVHLLLSHGANPFIPNDDCNTALDLAREKGHVNVVRALKGRLWLFCGWKREKHAPAFFGCNCPPFMTKKLGLLFSP

SEQ ID NO: 87479 - DNA, 1059 bp, Zea mays
  misc_feature: Ceres CLONE 1574552
  misc_feature: Encodes the peptide sequence at SEQ ID NO. 87480
  misc_feature (925)..(925): n is a, c, t, g, unknown, or other
  misc_feature (926)..(926): n is a, c, t, g, unknown, or other
  misc_feature (928)..(928): n is a, c, t, g, unknown, or other
  misc_feature (932)..(932): n is a, c, t, g, unknown, or other
ctggagctccccgcggtggcggccgctctagaactagtggatcccccgggctgcaggaattcgtctcacccctagaaaaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcgtggtctctccacatgagcatccagatcgtcgtcatcatcgagacactcaccgcgctcggcgcccaaggccggtggatgctcctgcaacttcttcttcacgcatgaaccactcggccggcgcctttcccttggcaattaggccccccgtgtttcccctggaaagggggaaacctcttgagggattaccggggggggggccccgagacccctcccttgtatcgggggacgaaaggcgggggggcccccatactttttttttttaacaaagggcgggggaaacccccccctttgtccataacacaaaaggggtctcaagggcccccggggagggatttccaaaaaaaccccggccaaaatcccccctgaccccgtggatcccccccggaacaacgcggggaatttttaaaaaattggggggccaccccttttttcccaaaaagaggggcttttggggtgccccccccatatatcccccccaaaaatataaaaaaaaacctttttctcccctcctcccaagagaaacccccccgggggtggtagaggggctcctccaagaaagaggaagaaaggggggcccccctttcggtatggnnanaaanaaaaaaatccccccccaaaaatatagtttaaccacccggtggggggcgccccccccccccccgggtttgggtggggggggccccctctttttccccgcgggtgggttgctgccgccaccaacataaa

SEQ ID NO: 87480 - protein, 92 aa, Zea mays
  misc_feature: Ceres CLONE 1574552
  misc_feature (12)..(93): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISWSLHMSIQIVVIIETLTALGAQGRWMLLQLLLHA

SEQ ID NO: 87481 - DNA, 1082 bp, Zea mays
  misc_feature: Ceres CLONE 1574554
  misc_feature: Encodes the peptide sequence at SEQ ID NO. 87482
  misc_feature (53)..(53): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
ctttttcgtctttcttttgccacatacacttcctcattattaatgttattttnttttccntnntttacaagctggggctccccgcggtggcggccgctctagactagtggatcccccgggctgcaggaattcgtctcacccctagaaaaattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgccatcgatcgtccgcggcaggcggtgcccgatgcgccggccgtctacttcctcccccccacccccgggaacgttggaccgagtagcggccgactccgccgcggggctctacgggtctttccacgtcaacttctccacctccgtcccgcgacccctgctggagcgcctcgcaaccgcctgcgccgccgctccgcccgcgtgtgctggccgcctggcgcgcgttgctgaccagtacatcgaacttcgtctgcctcgaggatgacctctttttcgctagcggaagcgccgggccctacggtcgcactcatacaaccccgcccgcttgccgatcccccacattccctgccctctcggccgaacgcccgtccacggctgggtcctctttctggctgaggtcgcccacgctccggttgtttgcgccctggtcttcatactttttgccccgcgggcggtccatcctttaaaaagggggggcctggcgcccttcgatacccgcagggttccggcaatcaccctacgtgccccaaaccctacccctttttacagggagggttgtgttccggccgcgctgtctattttactattccaggtcgcacctggtgtttgtggccccttcctaaacgagaaaatttctagcttggccctgttaggggtatgcactcaccccc

SEQ ID NO: 87482 - protein, 143 aa, Zea mays
  misc_feature: Ceres CLONE 1574554
MTLSLRRKQLDVIVRMLHLNQQQLPNGGEGQGEDDAYKILVMDPPCISILSPVLKLGDLRHQGVTLTLAIDRPRQAVPDAPAVYFLPPTPGNVGPSSGRLRRGALRVFPRQLLHLRPATPAGAPRNRLRRRSARVCWPPGARC

SEQ ID NO: 87483 - DNA, 937 bp, Zea mays
  misc_feature: Ceres CLONE 1574555
  misc_feature: Encodes the peptide sequence at SEQ ID NO. 87484
  misc_feature (859)..(859): n is a, c, t, g, unknown, or other
ctccccgcggtggcggccgctctagaactagtggatcccccgggctgcaggaattcgtctcacccctagaaaaactggcgcacagcacagtcacagtgctcggcatcttttccgctccgctctgacgctctcccactcccccacagtcccacgccctccagtcaaagcaagccgctgcttggccggccgggaaggctcggtcgcagcgccgaggaatggcggccaagccggtcaccgtcggcgacctcatccaccgcgtcgcctcttcctgcctctccaaccgcctgccgtgcaaccacaccttccgcgactccgtggacagcgactttgacgacgacgacgacgaccccttcgccgacgccgtctccagcagcgagaaatgccagcggtccccgcccgctgcggaggtcgaggaagaggaggaggaggacgagaagctcaagatctgggaggagagggagcaggagaaggagaggctggccgccgcgtccaagggcgccgagcgcgcccgcgacgcggacgcgctgatggcggaggtgttcgacgccgtctccggggtgcgccgcgcctacgccgcgctccaggacgcgcactgcccctgggaccccgacaagatgcggaccgcggacgcggccgtggtcgccgagctccgccacctcgcgcgcctccgcgaccgcttccgccgctccgcagccgtgagccacatcccgcgcccgataccgtccgcgacgccgctgcgcgatgacgtggcgccgtacgaggcagagctcgacgacctacagcgccagcttcagtccaggcaggacgtagtggacgcgctcaaagagagctcgcagcaggcaccagacgcggcagcggnagctacaccacgtcccgtcctcaagcagaaagctgcgcgtcgacggggtactcttcaccactgcgccgagaagccggc

SEQ ID NO: 87484 - protein, 240 aa, Zea mays
  misc_feature: Ceres CLONE 1574555
  misc_feature (89)..(220): Pfam Name: DUF641 Pfam Description: Plant protein of unknown function (DUF641)
  misc_feature (215)..(215): Xaa is any aa, unknown, or other
MAAKPVTVGDLIHRVASSCLSNRLPCNHTFRDSVDSDFDDDDDDPFADAVSSSEKCQRSPPAAEVEEEEEEDEKLKIWEEREQEKERLAAASKGAERARDADALMAEVFDAVSGVRRAYAALQDAHCPWDPDKMRTADAAVVAELRHLARLRDRFRRSAAVSHIPRPIPSATPLRDDVAPYEAELDDLQRQLQSRQDVVDALKESSQQAPDAAAXATPRPVLKQKAARRRGTLHHCAEKP

SEQ ID NO: 87485 - DNA, 868 bp, Zea mays
  misc_feature: Ceres CLONE 1574556
  misc_feature: Encodes the peptide sequence at SEQ ID NO. 87486
  misc_feature (398)..(398): n is a, c, t, g, unknown, or other
  misc_feature (485)..(485): n is a, c, t, g, unknown, or other
  misc_feature (496)..(496): n is a, c, t, g, unknown, or other
  misc_feature (559)..(559): n is a, c, t, g, unknown, or other
ctggagctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtncatcgtgctggtgtgcggcgccgagctgggcagcctcagccgcgacgagctgtggcgcaggtgttttgggggggagccacctacgancctcgccaccngtgctcgcctttcctcgccggtcctcgccctttcaccatctccgtctacatcattgtccaggnccccagggcccgtgtaccctcattcgactttcgcatggctacaagccgggcgaacgaagcctcaaggggtcccaagggcgaatttcattcgaccttgcggcgcaagtcccggcaagtttcacaagaacaagcccgggggtttccaattcccgtcggggttggccaaatccgggattcggggaaacaatcttaaatggcccccgccttggtgtgttataaaccaaagcccgtgtggccccaacccttaaagagggggccccccccagagggttccaccggcattgtttcccgcgcgcgggaaaatatttt

SEQ ID NO: 87486 - protein, 186 aa, Zea mays
  misc_feature: Ceres CLONE 1574556
  misc_feature: SWISSPROT Homolog: EC 2.3.1.119 Icosanoyl-CoA synthase
  misc_feature (98)..(98): Xaa is any aa, unknown, or other
  misc_feature (102)..(102): Xaa is any aa, unknown, or other
  misc_feature (123)..(123): Xaa is any aa, unknown, or other
MAREEQALLSTEIVNRGVEPSGPDAGSPAFSVRVRRRLPDFLQSVNLKYVRLGYHYLISHGVYLATIPVHRAGVRRRAGQPQPRRAVAQVFWGGATYXPRHXCSPFLAGPRPFTISVYIIVQXPRARVPSFDFRMATSRANEASRGPKGEFHSTLRRKSRQVSQEQARGFPIPVGVGQIRDSGKQS

SEQ ID NO: 87487 - DNA, 1018 bp, Zea mays
  misc_feature: Ceres CLONE 1574558
  misc_feature: Encodes the peptide sequence at SEQ ID NO. 87488
  misc_feature (370)..(370): n is a, c, t, g, unknown, or other
  misc_feature (381)..(381): n is a, c, t, g, unknown, or other
ctccccgcggtggcggccgctctagaactagtggatcccccgggctgcaggaattcgtctcacccctagaaaaatcccaaaccctagcatctctcatggacgacggcgacggcggactgagcttcgacttcgagggcggcctcgactctgccccggcggccgggggccccgtgccgtcctccactgaccctggcgcgggaggcggcgacgggccgggtatgcacgggcgcggccgaggtcgcgggagctaccgccagacggtgtgccgccactggcttcggggcctatgcatgaagggcgaggcgtgcgggttcctgcaccagttcgacaaggcccgcatgcccgtctgccgttttcttcggcgacttcngcgagtgcccncaagcccaactgccccttacaaccactcgtacgacgacctcaaggagtgcaacatggtacaaaagggggtttttgccccaatggccctaaattccccggttcaaagattttcaaggctccctggggccccccccccttctgtttgagggaaagttcttcccaaaaaatttttgcccagaatcccccccttttttaccaaaaaaccggcgcgaaaaataggaaaatgggtattttttataacccccccgaggggggaagggggcccccacaacccccccccgggggggttttgtgtgcgtttgtccttaacaaaaaattcttcctcaagaaaaaattgtgttttggggtggaagtccccccccacgtggggggggaaaaaaaacgccaaagaaggcgtggatattatcatccccctcctcgggtgggcgtgcgtaagcactaatttttatttacctccccgcccatgttggttttttaaggtgcgcttagggcgccctatattaatctcccccccctcccgtccaagaacacccaggtgtgttctcttttaaaaaaagcccctgcggggaggtgggaatattaccctccaagaatttcgccccctccagggatgagtgcctcctctctctttttcccc

SEQ ID NO: 87488 - protein, 143 aa, Zea mays
  misc_feature: Ceres CLONE 1574558
  misc_feature (92)..(92): Xaa is any aa, unknown, or other
  misc_feature (96)..(96): Xaa is any aa, unknown, or other
MDDGDGGLSFDFEGGLDSAPAAGGPVPSSTDPGAGGGDGPGMHGRGRGRGSYRQTVCRHWLRGLCMKGEACGFLHQFDKARMPVCRFLRRLXRVPXSPTAPYNHSYDDLKECNMVQKGVFAPMALNSPVQRFSRLPGAPPPSV

SEQ ID NO: 87489 - DNA, 958 bp, Zea mays
  misc_feature: Ceres CLONE 1574559
  misc_feature: Encodes the peptide sequence at SEQ ID NO. 87490
  misc_feature (626)..(626): n is a, c, t, g, unknown, or other
  misc_feature (717)..(717): n is a, c, t, g, unknown, or other
  misc_feature (741)..(741): n is a, c, t, g, unknown, or other
agctccccgcggtggcggccgctctagaactagtggatcccccgggctgcaggaattcgtctcacccctagaaaaataaaggccatctcacagaccgacaacgccctaggcaagcagcaagcgcacacgtaaacgtacacctacctcggcgagcaaaagggaaaacgctgatcggagcaacgaagcccgcagccatgccgacggcgacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctactgcgggcccgccggcgggtacgcccgcggcggcgtggtggcgcccaccgtgacgtgctccgagaaggggccctgctacaggaagaagtcacctgcccccagaagtgcttctcctcgtacagcggcgcccgcaaggggtacggcggcngcggctgcggctgcatctgcaccgtcgactgcaaggtcaagtgcacggcctactggtgattcgactcgtcccctgctggcgtgccgcttancggttgacagctagtgggctggcngtggcggcctgctacctgcttttggtgtgatggccctttgtcttgtccgtgaacctaatacgccgggtggttaactggggtttatctccccaaaaagaaccaagggaacctccgggtccgggggcaatttttttggaacccccctatggggaaggggcgggtttattccaaaaaaaaaaaaaaaagccccgggttaggggggaaaaaaaaaaaaaaa

SEQ ID NO: 87490 - protein, 178 aa, Zea mays
  misc_feature: Ceres CLONE 1574559
  misc_feature (20)..(106): Pfam Name: GRP Pfam Description: Glycine rich protein family
  misc_feature (175)..(175): Xaa is any aa, unknown, or other
MPTATATAAPRHAALFLPLLLLLLGLHATSAAAARAGVAVDAELTSTKPSPVPKKPSVKPPGPGAASPTFPGFGIPGMGGFGIPGMGAGGWGGGYCGPAGGYARGGVVAPTVTCSEKGPCYRKKSPAPRSASPRTAAPARGTAAAAAAASAPSTARSSARPTGDSTRPLLACRLXVDS

SEQ ID NO: 87491 - DNA, 940 bp, Zea mays
  misc_feature: Ceres CLONE 1574560
  misc_feature: Encodes the peptide sequence at SEQ ID NO. 87492
  misc_feature (447)..(447): n is a, c, t, g, unknown, or other
  misc_feature (528)..(528): n is a, c, t, g, unknown, or other
ggagctccccgcggtggcggccgctctagaactagtggatcccccgggctgcaggaattcgtctcacccctagaaaaagagagcacagagagctagcatacatcgctagctcactttagcatatatattacataaatattggcatatataaactaaactgaattgaggacgatatggcccgcttggtctcttccggaatcattggtaaggggcacaacatctttgacgatggcggattcggtgaagtccatgctgacccaattaaagtcgagcgtccgcacaagcgtccgccgcagaagcagaatgcggagaatggaacgacgacgaaggttgatgagccaaaggaattgcctaagcacgtgtgcttcaagggagacaacgggctatacctgagcgctcggatggtggaaggctacccctacctgcagtttgcgtcggacgacatangcgatccaagtgtgagggtcaccacgtacaactacatgatcgacggcaagcgggtgatccgcgtcaagtcggaacacttcngcaaagtctggcggcgcagcccaaactgggatctggtgcgacaccgacgacaccagcaccgaacaacgttgaccccctgtcgaggtcgtcaagggtgggcaatgacccccaaccccctggtacgggctccggaaacctcggaaaaaacaaatttgccccgggttgacctacaagggcaagggaaacttccctaacccagatttcccaggttccggaaggaagcccatcttaaaatacaagaggccctcccgcttggaaaaatcccgggggggaaccccccccagggacccaaaactctaaaaaaagggtgagaccccgggaatccaaagggggggaaaacccgcgaaattccccaaaaaaacggccccccctaaaagtgggtccaacccgaaaattggggaccccccggctt

SEQ ID NO: 87492 - protein, 182 aa, Zea mays
  misc_feature: Ceres CLONE 1574560
  misc_feature (92)..(92): Xaa is any aa, unknown, or other
  misc_feature (119)..(119): Xaa is any aa, unknown, or other
MARLVSSGIIGKGHNIFDDGGFGEVHADPIKVERPHKRPPQKQNAENGTTTKVDEPKELPKHVCFKGDNGLYLSARMVEGYPYLQFASDDIXDPSVRVTTYNYMIDGKRVIRVKSEHFXKVWRRSPNWDLVRHRRHQHRTTLTPCRGRQGWAMTPNPLVRAPETSEKTNLPRVDLQGQGKLP

SEQ ID NO: 87493 - DNA, 894 bp, Zea mays
  misc_feature: Ceres CLONE 1574562
  misc_feature: Encodes the peptide sequence at SEQ ID NO. 87494
  misc_feature (750)..(750): n is a, c, t, g, unknown, or other
  misc_feature (830)..(830): n is a, c, t, g, unknown, or other
ctggagctccccgcggtggcggccgctctagaactagtggatcccccgggctgcaggaattcgtctcacccctagaaaaaacacaccactacggcactgccctctcactcccgatccctgctgcactaccggctcctccggttcacccctctcgtagcctcttgcggcgaccggcggcggatcgtccgcggcgcaagcgcaaccatggggctcttcaccgtgacaaataaggccacaacccccttcgaaggccagaagcccggtacctccagcctccgcaagaaaggtactgtatgacatcagactcattatctgcagaactgtgtccagtcaacattcaatgccccgtcctgctgaccaagtaaaaggtgcaaacatctgtttgcctcttgggtgatggcccgcaattttgccaaaaggagggggttccagaccaataacaaaaaatgggggtggcggccccaagggaaaggaaagacccggggtgttgggggtttgggacaaaaaaaaaaaagcccccccaagggggtcaaaaaccccccaccttataaaaaaagaaccccggggtaatttcccggggggaaaaaaaaaaatattttttgcccccccaacaaatgggggattacaaaaaagagggggggtatgggcggggggggcccccccccctaaaacgtgtgcggggtggaacgatagcggccgcggccgctattaaaaaaaaacaaaagggggggtggggcccccccccctccncacgagaggccccctctgtcggggggggggtctaaaaaaaaacaacacacttttttcaaaaacaagggggacgcaagagnttgcccccccccattatataattcttttttcccccaaaaaaataaaattttttttttttttttt

SEQ ID NO: 87494 - protein, 30 aa, Zea mays
  misc_feature: Ceres CLONE 1574562
  misc_feature: SWISSPROT Homolog: EC 5.4.2.2 Phosphoglucomutase
MGLFTVTNKATTPFEGQKPGTSSLRKKGTV

SEQ ID NO: 87495 - DNA, 1075 bp, Zea mays
  misc_feature: Ceres CLONE 1574564
  misc_feature: Encodes the peptide sequence at SEQ ID NO. 87496
caatgctgtagctcaccgcggtggcggccgctctagaactagtggatcccccgggctgcaggaattcgtctcacaccttgaaaaaaaacatgagaactccatcattgcctttactcaaagtatagagctagctttttgctttgctcaccatgacaaaccgcagcagatggcgtcgactatcatggtcgccacctccagtatcgccccggacgagaagccttctcttggcaaaggtcgcgccaacgccgaccaccaccaatgccagccccctccgcgacgtctccgccgccgctgctggcggtcggatcaccatggacaacgacctgtggtacggcccggaccgcgtcaagtagatgaggacccttctccgcgcagacgccctcgtaccagaccagcgaatccccccccccacactgctgggtaaaactacgggctgtccacgtgaactcgatgcgtctccctcggaaaatggtcgcctggaagtgaatccacagaggggtgggcttatgcttgggtccaccagggttgttttcttccccggaggggacctggaaaaagggagtggcccctgggatttccaaagaaccccgtgtgggtttaataggcgggccgccccaatttttttttctgaaagggtcgaggggtgggaattatccttgataaatccccctatacttgggtggaatcagggcctaatagaatatccctttggccctgtgtgttcgaggattttcatgggtgaatatcccttcaatagggaccttctctttggagggaggtttccaccattcaaaaggggtggtgctacccgctgctctgagctaatagggatgaaaacattttttctcccggtgggactcgttattttagatacggcgtgggggtcctcggccctaattaacccccatttctatagggaccaggagcccacggtctctggtgatattaataaccggcgtcctgccatatagttctcctggattgagatttcttgggctagagctacttccattggattagggggcccctttaaaaaccgttcttaccattctaaaaaccctgtacgagatatccg

SEQ ID NO: 87496 - protein, 67 aa, Zea mays
  misc_feature: Ceres CLONE 1574564
MTNRSRWRRLSWSPPPVSPRTRSLLLAKVAPTPTTTNASPLRDVSAAAAGGRITMDNDLWYGPDRVK

SEQ ID NO: 87497 - DNA, 714 bp, Zea mays
  misc_feature: Ceres CLONE 1574568
  misc_feature (135)..(135): n is a, c, t, g, unknown, or other
ctcacccgcggtggcggccgctctagaactagtggatcccccgggctgcaggaattcgtctcacccctagaaaaaattcctcacacccacacaaaccgcacctcatccctgttgacccgacggtggcgctcatcntcctccccgacggtgagcgctcatcttccccccgacggttctccccatcgacctagctggcttcccttcgtcttccccgacactgatcctcaccactcatgtctgctgaagttgccggaggaaacccttatttcctctcatgctactttctggttcatatactgcataaaattccgagatttcacttgatacaagtggaacactaggagttttgtgcaaatactttcctaccatgtgaatcagttgtagctgggtgaatttgggcagactcaagtccctctcatctggggtcagaaaaacatctggtcgggttgatttggcttggggcctcccggtttccctttgaagtcctttgccaaaccaaaagttttcccccccaaccatcccaggttgggggggggctaagaaaaaccttttttctggggagaattggaccccaaaaattcctcctttttggggggcccccgggggaaaaaaattttgtgaaaacaacccccccccccttcccccaaaaaaaaaaaaattttttctctaaaagagaaggggcgggtattatttttcccccccccccccccccct

SEQ ID NO: 87498 - DNA, 963 bp, Zea mays
  misc_feature: Ceres CLONE 1574570
  misc_feature: Encodes the peptide sequence at SEQ ID NO. 87499
  misc_feature (138)..(138): n is a, c, t, g, unknown, or other
  misc_feature (185)..(185): n is a, c, t, g, unknown, or other
  misc_feature (205)..(205): n is a, c, t, g, unknown, or other
  misc_feature (257)..(257): n is a, c, t, g, unknown, or other
  misc_feature (945)..(945): n is a, c, t, g, unknown, or other
  misc_feature (946)..(946): n is a, c, t, g, unknown, or other
ctccccgcggtggcggccgctctagaactagtggatcccccgaggctgcaggaattcgtctcaccccctagaaaaaaaaaaaaaaaaacctgctccccctgttcccctctgaagcctacggggctcggggaggcttcngatcgaatcgaatcggatccggtatcggaagcatggtagatctcgcntcgaggcgtcgtgggtgggncgtgcagcggcacgggctaggacctggctggaccgcctctgcgcagggcttnctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaggcggggtccgagctcggtgcggcggttcagcatctcgcgcgccaggtgcctgtgcctgtgcccttccggaaatgggaagccgcacagccgccgaccgtggtgacgggggatgttgcgctcgctgtggggacggttgggtccgcgaacgtcgctttggaaagggctgtagacatagggtccctcgaggtggcagcggctgctgctgcggcggccactggaagtgccactgcaggtagtgtgggcgcggttggggccatggacgacgatagactggatgatgaggaagacggatttgattgcgaaattgggacattggagaacattaagaagggctagggcactgtaaatgtctcagcaacttacaacaccagggcacatgactttttgagagtcagtagtcgcacgaagaagaccctttgaggttggagtcatcgcgttggcaatttaacttcagggaatgatagctcaccactttttcctggnntcactggggcctttacg

SEQ ID NO: 87499 - protein, 138 aa, Zea mays
  misc_feature: Ceres CLONE 1574570
MRRGVGTVDLPAVAVSSLVEIGGRLGQAGSELGAAVQHLARQVPVPVPFRKWEAAQPPTVVTGDVALAVGTVGSANVALERAVDIGSLEVAAAAAAAATGSATAGSVGAVGAMDDDRLDDEEDGFDCEIGTLENIKKG

SEQ ID NO: 87500 - DNA, 702 bp, Zea mays
  misc_feature: Ceres CLONE 1574572
  misc_feature: Encodes the peptide sequence at SEQ ID NO. 87501
  misc_feature (289)..(289): n is a, c, t, g, unknown, or other
  misc_feature (461)..(461): n is a, c, t, g, unknown, or other
  misc_feature (581)..(581): n is a, c, t, g, unknown, or other
  misc_feature (659)..(659): n is a, c, t, g, unknown, or other
tggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgcccaacgacccaggttaaccgcaacacgnccctcggtacgttcgcttcaccggaattcccaaacggcccttcatccggaaaatggcgggcccaaaaaaaccccagggggccccccctgttaaaccccccctttttaaaaaaccccccgtttttttttttaatgggcccccaaaaagggggtttttttttttttttggtttnaaaaaaagaagagagaggggtgtctcccccccgggggggggatgggggggcgcccctctttttttttttttctccctcacacccgggggggggggggggttttatttttttctccccccncctttttttttggtttgggggggggggggggcgcccccccccccccccccccttctgatggggagggggggggggggntttttttttttttttttcttcccgggcgggggggtgggggcgc

SEQ ID NO: 87501 - protein, 72 aa, Zea mays
  misc_feature: Ceres CLONE 1574572
MAGKGDGPAIGIDLGTTYSCVGVWQHDRVEIIAQRPRLTATRPSVRSLHRNSQTALHPENGGPKKTPGGPPC

SEQ ID NO: 87502 - DNA, 873 bp, Zea mays
  misc_feature: Ceres CLONE 1574574
  misc_feature (155)..(155): n is a, c, t, g, unknown, or other
  misc_feature (179)..(179): n is a, c, t, g, unknown, or other
  misc_feature (193)..(193): n is a, c, t, g, unknown, or other
  misc_feature (195)..(195): n is a, c, t, g, unknown, or other
  misc_feature (617)..(617): n is a, c, t, g, unknown, or other
  misc_feature (783)..(783): n is a, c, t, g, unknown, or other
  misc_feature (791)..(791): n is a, c, t, g, unknown, or other
  misc_feature (829)..(829): n is a, c, t, g, unknown, or other
agctccccgcggtggcggccgctctagaactagtggatcccccgggctgcaggaattcgtctcacccctagaaaaaccctcccccaccgccattgctcagcagcagtagtaaagccacgcctgacagacagctggttcatttctggttgctgccnttgctgtagtagccctcggcgcangcagccaagaacananagagcgagatggatgtgaacgacgtgcctgctagtggtgcctggcggcggcccctggcttgccatgtgggtgggcttccgggcctccaaaaaccggggggtttcaaaagggccccccccccccgggggccctcccggtttttgccccggggtggggggaaaaacccttttccccgggtgtatacctctccggaaaaaaagggccccccctctttgttttttggtggggccccccccccccgaaaaaaaacggggcccccctccccccccgggggggggggggggcccccccccttttggggcccccccgggggggaatctccccaaaaaaggttttttaaaaaaaaccccccttttttttaccccccccaaaaaaaaaccccccccccccccccttttttttttggggggggaagggggggntttttttcccccccccccccccccccccggggggtggtttgttcccgcccccttttttcacaaaaaaaaaatggcccccccccccccccaaaagatgtttttcttttcttttgccggggggggggggggggggaaaatttttttttcccccccccccccccccccnggggaaanaaaaaaaagggggggggtttttttttttaattaaaggncccccccccccccccccaaaaaaaaaaattttttttttggtgtc

SEQ ID NO: 87503 - DNA, 884 bp, Zea mays
  misc_feature: Ceres CLONE 1574575
  misc_feature: Encodes the peptide sequence at SEQ ID NO. 87504
ctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcaaagaccacttcccgtcttcctcccgtggctgtctgtcatctggctctgatacgatggcagtcctgcaagttgctgctgctgcccctccccctgtctctgggaatgggttcgaggggatttgaaaaacgccctttgaaacaagctcttccggagggccctgtgttttggctggaccccccccgaaaagggggaattggggggcgccccccccggggggcccaaaaaaaaaaccctcttttttttaaacccactttggggggggggcaccctttgttgtgggggggcccctctcccaaagaaagagagtgtcttttt

SEQ ID NO: 87504 - protein, 51 aa, Zea mays; identical to SEQ ID NO: 13325
  misc_feature: Ceres CLONE 1574575
  misc_feature (1)..(51): Pfam Name: AdoMetDC_leader Pfam Description: S-adenosyl-l-methionine decarboxylase leader peptide

SEQ ID NO: 87505 - DNA, 994 bp, Zea mays
  misc_feature: Ceres CLONE 1574577
  misc_feature: Encodes the peptide sequence at SEQ ID NO. 87506
  misc_feature (491)..(491): n is a, c, t, g, unknown, or other
  misc_feature (941)..(941): n is a, c, t, g, unknown, or other
ctggagctccccgcggtggcggccgctctagaactagtggatcccccgggctgcaggaattcgtctcacccctagaaaaaatatcactcactcacactcacaactcacaagcaggcacagctagctgctcacagctatacatcggcgcatcgccattaccagcggcttgctttggttttctgattgattagctggttgttgtccagttagttcgagtagtagacgatgtactctctaccaggagcaaccatgtctgctgcacctgcacgcgtcatctcttcttcctcctcctccttcgtggagcctcttctccttgcagcagcttcgccggcggcggcggcggctgcaaacagccaccaccaagtccgccagcgcggccacttggtccgtactttggcggcatcatcgtcgtccaacacgctgctgcggagtgacttcgatctccatgagggcctgacgacggacgtgaaacggatgctgcgtcagcgtancagcggcgggcgggagatgctggtcaccatcgacaacctcaagcgcctctgcatcgaccactacttcgaggaaaagatcgagggcgccatggggaacggcgccctgaacagttttcctccaaaggaacgaactcttcaaagaaacccttcggtttaaggcccctgaaaaaggcaggccattaatgcccaagaaaaaaaaattttttatacgaaggtctattaacggggttcagcggggaatttcaaaatctcttgaacaacaaacccaaaaagggtcctaaacccggcaaaaaattgtccccctgaaaaggggaggggggaggggccccctcccccccgggggaaagaagttttggaaaaggcccccccgccccccccccaggaggacgggaaaacacccacctccccggaaaatatggggggagcccgggagaccccccccacctcttnttcccccccaaaagaggcgcccagctcttcccccctcatctaaggaagccccc

SEQ ID NO: 87506 - protein, 132 aa, Zea mays
  misc_feature: Ceres CLONE 1574577
  misc_feature (81)..(81): Xaa is any aa, unknown, or other
MSAAPARVISSSSSSFVEPLLLAAASPAAAAAANSHHQVRQRGHLVRTLAASSSSNTLLRSDFDLHEGLTTDVKRMLRQRXSGGREMLVTIDNLKRLCIDHYFEEKIEGAMGNGALNSFPPKERTLQRNPSV

SEQ ID NO: 87507 - DNA, 926 bp, Zea mays
  misc_feature: Ceres CLONE 1574578
  misc_feature: Encodes the peptide sequence at SEQ ID NO. 87508
  misc_feature (926)..(926): n is a, c, t, g, unknown, or other
ggccgctctagaactagtggatcccccgggctgcaggaattcgtctcacccctagaaaaatctccgcgtgccccgccgctgccgaggtgagctccgaacgcccgccctccgccgctgccgagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggagatggattctgtgagaagttggttccagaagttccagccgagagacaaatcgaagaggccagtggtggctgccacacatggaaaagatccaggaaagcccccgatggatgatgccccttctagtgcgacgaaacagagggtcgccgctgcaaaacagtacattgagaaccactacaagacccagatgaagtccctgctagataggaaagagaggcgctggatgttggagagaaaattacaagatgccgaagttcctgtagaagagcaaaataacattcttaagcatttggagaaaaaagagactgaatatttgcgcttgccgagacaccagatgggagttgaagatttttgaacctttgactatttattggggagagcgcatttcggataagtgcgtctcctgtgaagaaacgcctcttataaggttacgccatgaaaaagtccagatatctgtaatgcttcctagggggccaggtgaaatgttcaacgcttaaggacctttctgctgaagttgatagggctttccaggttaagatcttttatccttcctggaacaaagattcttatttttcacccggaaatacctccctggaggaaaaatgagaacttggcttttccccn

SEQ ID NO: 87508 - protein, 116 aa, Zea mays
  misc_feature: Ceres CLONE 1574578
  misc_feature: SWISSPROT Homolog: EC 2.7.11.1 Non-specific serine/threonine protein kinase
MDSVRSWFQKFQPRDKSKRPVVAATHGKDPGKPPMDDAPSSATKQRVAAAKQYIENHYKTQMKSLLDRKERRWMLERKLQDAEVPVEEQNNILKHLEKKETEYLRLPRHQMGVEDF

SEQ ID NO: 87509 - DNA, 914 bp, Zea mays
  misc_feature: Ceres CLONE 1574581
  misc_feature: Translation starting site: 182
  misc_feature: Pfam Name: COG6 Pfam Description: Conserved oligomeric complex COG6
ctccccgcggtggcggccgctctagaactagtggatcccccgggctgcaggaattcgtctcacccctagaaaaagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgctgccccgccgcgcgccgccgtccccgtcgccctccgcctccacgcgcgccaagccgcgcccccctcccgcccccaccgacgactcgctggacaacccggatctggggcccttcctcctgaagcaggcgcgcgacgccatgctgtcggtgcgagggcggcggcgccgcgcgcgcatctggagttagccgaacgcgccgccagtgaactacaccgccaagaagagggagcaaagctcgagctcgccatgagcctgcactgcggacaccgccatccactagcggacacgggcgacacgaacacgccagtcatcaccctcaagcgagaaatcgtgtcatgcttcccgccggattacaaacttgcacacgaagagataaacgcacaccgggaagaggaggcagacgacaaattgggcagaggattgctgcctggtcaagatatacagtagaactgcaagggcctgctgacaacacaccgcccggggcttggagagaacttacggatatgaggccggggcaccagaaggggcttactgaagattaggaagcgggttcaagctaaaggaacaaataggggaacggaaaatccgtaaggaatgaaccttgaaaaaggtgcttgctaccgaacgaaaagacgtccagtcaatattaggaaaagagctgc

SEQ ID NO: 87510 - DNA, 966 bp, Zea mays
  misc_feature: Ceres CLONE 1574583
  misc_feature: Encodes the peptide sequence at SEQ ID NO. 87511
acccgcggtggcggccgctctagaactagtggatcccccgggctgcaggaattcgtctcacccctagaaaaaatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccgggaaggtgctcatgaacgatttccagtctaaagagctccccaacacccgcatcgagcccgaccgccggtggttcggcaatactcgcgttgtgggccagccacagcttgaaatggtccggggaggaaactcagagtcggctttcccgacacttcagtgtcatcctgaaagaacggaagctgccactatcgctcctgcaagatcatcaaaaagcagcgaggcacatctgcttgaaattgaaccttttgagcatgcttttgggcccaaaggggcagaggaaaacgtccgaaactaactgcccttgactacaaatctttgctggagaaagcttgatgattcccaagaggggtttggaccaaagttggcttcctcaaattgccaagggaggaaaaaaaaaaggccttccgttaccatgggggctaaaattgtttaaaaaggacaaaccaaaaatccggggggaaccttaaaagttttgtcccccccaactttttttgccggggtgtggcccccgggtccctgggggcccctctccccccctttagagacctctaaaaaaaggggcccccaacccgggggtttctcaaaaaaagggggacaacccccggggggccca

SEQ ID NO: 87511 - protein, 156 aa, Zea mays
  misc_feature: Ceres CLONE 1574583
  misc_feature (49)..(157): Pfam Name: NGP1NT Pfam Description: NGP1NT (NUC091) domain
MAKKKEKAVNVSGKPRHSNDVNRPNDKKGAGGGAGGGSRSAATVRRLKMYKTRPKRDRAGKVLMNDFQSKELPNTRIEPDRRWFGNTRVVGQPQLEMVRGGNSESAFPTLQCHPERTEAATIAPARSSKSSEAHLLEIEPFEHAFGPKGAEENVRN

SEQ ID NO: 87512 - DNA, 962 bp, Zea mays
  misc_feature: Ceres CLONE 1574584
  misc_feature: Encodes the peptide sequence at SEQ ID NO. 87513
ggagctccccgcggtggcggccgctctagaactagtggatcccccgggctgcaggaattcgtctcacccctagaaaaaacgcacgatagccgccgccgtcgaccagagcactcccccgtcgtcgccacgatgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtggtcccatgtcggcgacctccacgactccgctgcgggccgctccgtgcttatccgcggagccgcgcaggccatccgtccggtcagcaagaagatggctttcgtcgtgctgcgccagagtatgagcaccgtgcagtgcgtgctcgtcgccagcgccgacgccggcgtcagcacgcagatggtgcgctttcgcaccgccctcagcaaaggagtccatcgtccacgttgagggcgtcgtctccccttcccaaaggagcccctcaagggccccacacagcaagttgagattcaagggaggaagatcttttgcatcaatagggctattccgacccttccaattaaccttgaagatgcggctcggagtgaggcagattttgagaagggcgaattggctgggcaaaaccttgttcgcgtgtcccaagatacccgcttggaactacaaagctttgtgtcttcgaaaccccttcaaccaagcccatattccggaacccgtgtgtaagttggaaaacaaattttagagatttttggtgtggcaagaaacttttggcgggatccccaccccctaattgttttgttgggtcttgagaa

SEQ ID NO: 87513 - protein, 157 aa, Zea mays
  misc_feature: Ceres CLONE 1574584
  misc_feature: SWISSPROT Homolog: EC 6.1.1.12 Aspartate--tRNA ligase
MSSEPPPASSAAAGEELAADLSAATLSKKQQKKDARKAEKAEQRQRQQQQQQQPADAEDPFAANYGEVPVEEIQSKAISGRSWSHVGDLHDSAAGRSVLIRGAAQAIRPVSKKMAFVVLRQSMSTVQCVLVASADAGVSTQMVRFRTALSKGVHRPR

SEQ ID NO: 87514 - DNA, 902 bp, Zea mays
  misc_feature: Ceres CLONE 1574586
  misc_feature: Encodes the peptide sequence at SEQ ID NO. 87515
  misc_feature (755)..(755): n is a, c, t, g, unknown, or other
ctccccgcggtggcggccgctctagaactagtggatcccccgggctgcaggaattcgtctcacccctagaaaaaactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaagacagcctggcgttccagtcgcgtctgctggccaagtccggcatcggcgacgagtcgtacatgccgcgctgcgtgttcgagcccaacgccagctgcgccaccatgtaagatgggncgcgcgaggcgtccacggccatgttcgcggcgctggacgagctgttcgacaagtgccgcgtccggccaaagacgtgggcgtgctggtggtcactgcagcctctcaaccgacccctcccctgtcgcatgatcgtcaccactacagatg

SEQ ID NO: 87515 - protein, 191 aa, Zea mays
  misc_feature: Ceres CLONE 1574586
  misc_feature (115)..(192): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNASCATM

SEQ ID NO: 87516 - DNA, 897 bp, Zea mays
  misc_feature: Ceres CLONE 1574592
  misc_feature: Encodes the peptide sequence at SEQ ID NO. 87517
  misc_feature (841)..(841): n is a, c, t, g, unknown, or other
  misc_feature (842)..(842): n is a, c, t, g, unknown, or other
catagctggagctccccgcggtggcggccgctctagaactagtggatcccccgggctgcaggaattcgtctcacccctagaaaaaaacctcgtgttcgttcggagcgcacacacacacaaccagatctctcccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaccagcagcggctcatctttgctggaaagcagcttgaggacgggcgcacgctggccgactacacatccagaaggagagcaccctccacttggtgctgcgcctcaggnngagcatgcagatcttcgtgaagaccctgactggcagactatcaccctccgagtgg

SEQ ID NO: 87517 - protein, 232 aa, Zea mays
  misc_feature: Ceres CLONE 1574592
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(228): Pfam Name: ubiquitin Pfam Description: Ubiquitin family
  misc_feature (227)..(227): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYTSRRRAPSTWCCASGXACRSS

SEQ ID NO: 87518 - DNA, 933 bp, Zea mays
  misc_feature: Ceres CLONE 1574593
  misc_feature: Translation starting site: 279
  misc_feature: SWISSPROT Homolog: EC 2.6.1.13 Ornithine aminotransferase
ctggagctccccgcggtggcggccgctctagaactagtggatcccccgggctgcaggaattcgtctcacccctagaaaaaagaaccgtttcgtggctccaatccgtgaaaaaacgaacgggccgccggctcggacccggaggctgcagcggcaccgggatctgggaatctgcacggcctggagcctccagcgactggccccaccaccatctgcgcgcgcgcgcgagggaccggccggcgaacagaggcgccactgagctctgagcgggtgcggccggcatggcgacggcgctggcgcggcggggcgccgcggccctggcgcggtggcgcgggatgtgctcgagctcggcgtcggcgccgcggagcgccgcggcgctgtcctcagaggagctcatgcggatggaacaagactgcagcgcgcataattaccatccaatccccatggtgttttcccaaggagaagggtcacacatagtggaccccgtaaggcacaaatacattgattttctctctggctattctgcagtcaatcagggtcattgcccatcaaaaagtcctgagagctttgatagaacaagcagaaaagcttacgctcagttctagagctttctacaatataagttcccaatctttggcgaatatctgacagcatgtttggatatgacatgaagttgcccaattatcccgtgggctaaagaattgaaactgcattccagctggctaagaaatggggttttggaaaaaacctttccccaaaaaggaggctttgcctgccccttggcggggggggtttccagggcaaaaccctgggggtctttcctagagggtgaaacacagacaacccggggtttgggccctttggtcccgggccctcaaattgttttgggaaaattgtggggggtaaaaaaaacctcaaaacgggggagaggtggtg

SEQ ID NO: 87519 - DNA, 961 bp, Zea mays
  misc_feature: Ceres CLONE 1574595
  misc_feature: Encodes the peptide sequence at SEQ ID NO. 87520
ctggagctccccgcggtggcggccgctctagaactagaggatcccccgggctgcatgaattcgtctcacccctagaaaaaggacaaatccttcgataccatacagccagagcggtaagaagaaacgaaaacggttcactggaatcgaccaaaaaatccgccttgccatctccctctcctatatgccctgacaatttccagaccaaatttccgaacttttccctcgccgcgcgaccttcgatctcgcttgaaagagatggcccagatcacgggaccggtgtgaggactgagacgccgacctccgacctcaccgaggcattcgattcgtcgcaatcctcgccctcactcgcgtgttcaggtttgtggggctgccccgggataggaatgcttctgtcgacaccccccccccggagccgtgcggttgctgttgtatcgtctccggcctccgcctctgcgtttgagttggaagccgagcggtgctatgccatccgccgccgcctaccgctcctgcctctgcaggttcgcctactcgaccgcgcgcgtcgagaggggcaggaccctgccgggcaaggcggtatttcttgatctgggagccgggaggaagttcacgccgagcggcgcgcttatcttgaggggttgcttgggttggcgggatggtggctgccaaccgccagttccatgagtagggtggaccgaaaaggcgcggggatgaatggccaagtgcttccccagcaagcggcagctgaggcgcatccgggagtggctgccgctcgaagaagccgccccaggcaaaaccctgaaccggaataggtgcctgttcgccagggaaaccgctaaggtttcctggaacaggatacggcttaaaagggggtttccgcttaatggaaataaaattctgggtagctctctggggccacggaaaaatttttgccgaagcttttttttgaactcacccattacaa

SEQ ID NO: 87520 - protein, 66 aa, Zea mays
  misc_feature: Ceres CLONE 1574595
MPSAAAYRSCLCRFAYSTARVERGRTLPGKAVFLDLGAGRKFTPSGALILRGCLGWRDGGCQPPVP

SEQ ID NO: 87521 - DNA, 905 bp, Zea mays
  misc_feature: Ceres CLONE 1574596
  misc_feature: Encodes the peptide sequence at SEQ ID NO. 87522
  misc_feature (727)..(727): n is a, c, t, g, unknown, or other
  misc_feature (751)..(751): n is a, c, t, g, unknown, or other
ctggagctccccgcggtggcggccgctctagaactagtggatcccccgggctgcaggaattcgtctcacccctagaaaaaaaaggaaggcttgtgttgtgtttggctagggtttgctcgcgtctcctccttcccttggctgctgtcgtgccggtcggcggcgacatgtcgaagaagaacaatcttgccaagaggaagaagcagtacgagttcgacctccaacgggagaaggaggccaaggagaagcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcagcttaatcgtcgagccagagttggaactctgaattctgtgcccacatgaatagctcccgtcgggtgcagctgcagcttgttgaacctttctttctaaaaagaatgtcattcttgcttttttaagggtaatcaagctctagttataggttttggtgataacgactatgatgttagagaactaatgagatttatggagctaaatgaaaaagagaaaaaaaaaacaagctcgaccacaacccagctcgctcgtcccagctgatcaggtcgagcacctagtagcgacctgctcgatcatcantgtagagtgtccggtaggtgtctngtctctctggtggctgggtgcaacggtcatggcgacgtcgtctcctcgggtgcccttgctgctgctgtgccctgggcgtgctggtggccctgctccttcccggcgggcagcttggacaagaacctggacttccctggggccaccgggcggggca

SEQ ID NO: 87522 - protein, 80 aa, Zea mays
  misc_feature: Ceres CLONE 1574596
MSKKNNLAKRKKQYEFDLQREKEAKEKQAKKLQAKKSKMKIDGAEKKRKGGQFKVGKKKVKTKLSALAKAKAAQAMEVDK

SEQ ID NO: 87523 - DNA, 2334 bp, Zea mays
  misc_feature: Ceres CLONE 1574597
  misc_feature: Encodes the peptide sequence at SEQ ID NO. 87524
aatactggaggaggaggaggaggaggagagggagaagacgaagcgaagccagggcaaggtcgtcggagccggagagggaggaaggtggagaacctctacctgcgtcacgtgacaactgtctcctgacccacaggagcggcggactccctctgctcgccgcgcgcggcctgttccggttcggtcggcggccgacggccggcggcggaggcagcaggaagctactgtaccaaccggcccaagagaattgcgggtccagaggcagtgatggcggggcgctacgattgacgtgctacgattatgggcatccaagggaacaaggcggcgacgcacgagcacgacttcctctcgctgtacgccgccgccgccgccaaggacgcccttctcctgctacacgactccaaggcgccgcctccctctcaaggtaatttcctcttgaagacgcacgacttcctgcagccgttggatcagaagccgggagcgccgccggagccgtcgccgctgcccgcttccgccgcggagagcaggcaccagccgcagcagcaggtcgtcgtcgcgaaccagcacgcgctgcccctgcccggcggcgtcggcaccttcagcatcagccccgcgcccgtgtccgtcgcgctgccggcggccgtcgtcaagtcggagccgccgttcgtgctctggggccagcctgccgcgacgctccatccgggcgcgcgagggcaccagcagcagtgggcgctccccttccccggcgccgggcaggtcaggctgccgccgcagcaggcgcctccggatagaaagggccggggcggcgccggtggcggggtcatggagtctggctccagatccagcggcgcggcggggttcgacgacgacgacggcctcaccacgcgccgcgaggtctcctcttcgctccaagatttgacagtaagggtggaccggaagggtgggagctgcagcgatggtggtacggatcagcggccaaacacaccgcggtcaaaacactcggccacagagcagcgcagacgcagcaagatcaatgataggtttcagatacttagggagctgttgccacacagtgatcaaaagagagacaaagcaacatttctcttggaggttattgaatatatacggtttttgcaagagaaggtgcaaaaatatgaggcaacatttccagaatggaaccaagaaaatgcaaagatgcttccatggtcaaatatgtattttcgatcattctggaaaaatgcacagagtaaaggccaaatctcaggagattccccgcctgacccttcacatttcatgagaaatggatcctcccctggatctaatttcactgggaaacttgatgataatcacaacatagtgacatctgcagctgcatcaggggcacaggatcaggcagaaaccgaccacatggctagcggatgctacagatcagcagaaactacggcgaattttacaaataatgctatgtctcagtcccaacctcaatggaccggtccgtcccctgtggatgactctgcaatgaacagtgagacgcttaacaaccagcagttggtgattgatgaaggaacaatcagagtgtccagtaactattcccaagagttgcttaactcattgactcatgcccttcaaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagctgacgctgtcgggtgccggtgccgacggcctctctcacgcaacaaagcggcataaacggagcaacagctgatgtccgctctccctcacctcgctccccgacggacggacggatgacggattggtgacattcttcttttccctcccagccaacggggaggctcgtggattggctggctggctgtacattgtgtgctgtgcttggtgacaagctgagacctccggcgtattctttgattcgatcacccccccgcccgccatcccattgtttacgtagagaagaggaaccgtggagctttccatcgcggattgtgaagccgctcttgtacacaggcttccattcaatgtgagaagcttccccctccttgacagatctccgtgttgtagacctgtagccacctgtaagatatgtgatgatgcccaacaaacaactctgccagaccactggctagtcgagttgttgggttacttatgtacggtgttctgttatgctgggagtgtaattgccctgctgtctcagtgaactgatcgtcagttgtgtgcttgtcaaaaaaaaaaaaaaaaa

SEQ ID NO: 87524 - protein, 514 aa, Zea mays
  misc_feature: Ceres CLONE 1574597
  misc_feature (229)..(279): Pfam Name: HLH Pfam Description: Helix-loop-helix DNA-binding domain
MGIQGNKAATHEHDFLSLYAAAAAKDALLLLHDSKAPPPSQGNFLLKTHDFLQPLDQKPGAPPEPSPLPASAAESRHQPQQQVVVANQHALPLPGGVGTFSISPAPVSVALPAAVVKSEPPFVLWGQPAATLHPGARGHQQQWALPFPGAGQVRLPPQQAPPDRKGRGGAGGGVMESGSRSSGAAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWSNMYFRSFWKNAQSKGQISGDSPPDPSHFMRNGSSPGSNFTGKLDDNHNIVTSAAASGAQDQAETDHMASGCYRSAETTANFTNNAMSQSQPQWTGPSPVDDSAMNSETLNNQQLVIDEGTIRVSSNYSQELLNSLTHALQSSGVDLSQANISVQINMGKRAAKRPAAGVSSNSKEPADPASSNELGHQLTLSGAGADGLSHATKRHKRSNS

SEQ ID NO: 87525 - DNA, 879 bp, Zea mays
  misc_feature: Ceres CLONE 1574598
  misc_feature: Translation starting site: 311
  misc_feature: Pfam Name: DUF828 Pfam Description: Plant protein of unknown function (DUF828)
  misc_feature (806)..(806): n is a, c, t, g, unknown, or other
ctggagctccccgcggtggcggccgctctagaactagtggatcccccgggctgcaggaattcgtctcacccctagaaaaactctctctctctctctgaactggcatttgggccatcgatcactggtaacgcgcccgctcactcactcgcatcacactccgtaactccccgacccccgcgcgcatgggcgatccccgggcccgcacgtccaccgtcgccgccggcgagctgcggccgccgtggccgccgtggcggcggcgacggccgcggcctcggcgtccggcaaggacgagcgggccgcccgcacggacatggccgtggcgtcggcggcgacgctcgtggccgcgcagtgcgtggaggcggccgagtccatcggcgccgagcgggagcacctggaggccgtggtcgggtcggccgtcaacgtcaggacgcccggagacatcgtcaccgtcaccgctgctgcggccaccgcgttgagaggcgcggccacgctgaaggcgagggctctgaaggaggtgtggaacatcgcggccgtgatcccggtagagaagggcgcggtcggcggcggcggcggcggcggcggaggagggcacaaccagaagcacggcgcgtccaagcagcagcagcatcgcaagctggagagcaacggcagcagcgtcagcgacgtgtcgctggaggaggagacaacttcctcggcatctgcagccaggagcttctcgctcgcggcaccgagctccctcaacgcacacggaaaggcgctctgcactggaaggtcgtatcggtgtacatcaaccggatgggcctggntgatgtgaagatgaagagcggcatgtggcggggacgatcacgaagaaaaagaaagcgtggtgatcgacgtgtg

SEQ ID NO: 87526 - DNA, 979 bp, Zea mays
  misc_feature: Ceres CLONE 1574607
  misc_feature: Encodes the peptide sequence at SEQ ID NO. 87527
  misc_feature (979)..(979): n is a, c, t, g, unknown, or other
tggagctccccgcggtggcggccgctctagaactagtggatcccccgggctgcaggaattcgtctcacccctagaaaaacactcgtggaaagcattagacaaatcagcacctgggcttgtcatcaaccgccgcgccgcgccgactagtcggtggccgtagcgcacctgtaccgcccgcaccgcgcggtcgaacacctcgcgcgcatccatggccaccacccacctcctcactccaccccgcgtccaccacccttccccctccgcttcctcctctgtggctcgcgtccgcgccaccgcctcgctcgcgcacccgctccacctctgccgcctccgcctcgccgccccgcgctcgcgctccccctccccgaggtacgggcggcgcgccatgtcggtccccacctccctgttccacccggacggcggcgcgctcgtcgaggtcgcccccccgcccgaccgcctcccggggctgctcgcggaagcggaggcgcttcctcgggtgcgcctcccccccgtcgacctccagtgggcgcacttgttccccaatgggtgggccagccccgctcccggggttttttgcgcagaccccaatccctgcgaaagcccccacttgtaatggttttgccccctccccaaagggggccttctttaaataagtcgctcccccctttgggttttgccctcttggggtaccccgacacgggatcataattgggcggttaaacccacaccttgcgttttttaggttctcaacggctgttttttctcccctcctccgcgtcaactttaaaaattttctccccctcgctgtgagagaagatattcccactatttggggatgaaagttgtttccttcgttaccacaccctttatggcgatcttgtctttgtggtggttccactgttgtattctcggattttctgacggggggatgataccgactcatattagagaggcgtgggttacgtctagctttcgcccn

SEQ ID NO: 87527 - protein, 75 aa, Zea mays
  misc_feature: Ceres CLONE 1574607
MSVPTSLFHPDGGALVEVAPPPDRLPGLLAEAEALPRVRLPPVDLQWAHLFPNGWASPAPGVFCADPNPCESPHL

SEQ ID NO: 87528 - DNA, 944 bp, Zea mays
  misc_feature: Ceres CLONE 1574608
  misc_feature: Encodes the peptide sequence at SEQ ID NO. 87529
  misc_feature (475)..(475): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
  misc_feature (750)..(750): n is a, c, t, g, unknown, or other
  misc_feature (751)..(751): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
tggagctccccgcggtggcggccgctctagaactagtggatcccccgggctgcaggaattcgtctcacccctagaaaaaatccccggtgcagaacgcccaacggctgtgctgccaaaagtccggaccacagctcgcgccgcccgccgcgccttgcccagacgtgcgctcccttctcccgcgccgtcgccactgccctggccgacccgctgggcccagtgtgcgcagccctcccgggttaaggcggaggtgcttggggacccgctcccatggcgagcgccggcatcagcggcagcggggacgacgatgcaggagggaagctcttggcggatcgctaccagaagggcgaggtcctcggcgagggcacgtacgcgagtcgtcttcaaggccatcgacaccaagactggaaatacagtcgcggtaaagagaatctggggtagggaagggacaagaaggaaggtgttaacttcaccgcanttgagggaaattaaactacttaaggagctgaaaggtcctaatattatagaggctgattgattgtttcccctaccaaggaaattttgcaccttggtatttgagtttatggggaaccggatctgggagctctccataaagataagaaacataaattactgtctccagctgacacaaaatcataatcttccgaatgctggtaaaagggtctattcgttctctgctcctaaaaaaatatgtggnngngaccccagggatatgagccaattattttcccnncatggtgccaataggcgacnnnncagctcgctacttgtcctggcccggatgttgggagtccagaagacttcctcccaggtcttggccgtggtaccggcaccaaaatatattgtcgagactttggatctgggggtgatattgggccccctggggaattttgcgaacgctaccccagactttttccaggtttagg

SEQ ID NO: 87529 - protein, 76 aa, Zea mays
  misc_feature: Ceres CLONE 1574608
  misc_feature (57)..(57): Xaa is any aa, unknown, or other
MQEGSSWRIATRRARSSARARTRVVFKAIDTKTGNTVAVKRIWGREGTRRKVLTSPXLREIKLLKELKGPNIIEAD

SEQ ID NO: 87530 - DNA, 927 bp, Zea mays
  misc_feature: Ceres CLONE 1574612
  misc_feature: Encodes the peptide sequence at SEQ ID NO. 87531
  misc_feature (632)..(632): n is a, c, t, g, unknown, or other
  misc_feature (744)..(744): n is a, c, t, g, unknown, or other
ggagctccccgcggtggcggccgctctagaactagtggatcccccgggctgcaggaattcgtctcacccctagaaaaaaagggcccaaggcttctctatctagggattcatcttcctctcgtcttccctcttcctctccgaggatacaaggcgccgtcccaggtagaggtagggtcgctaccatgctggaggagctgctcatcttcacccggggcggcctcatcctgtggtcgtcctgccgggcgctcggcgccgcagccctcaagggctcccccatcgacgccctcatccgctcctgtctcctcgaggagcgatccgccgacgccagcttctcccaggacaattacgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgactttggggacatcttccgccagctccaccgcgaggccgaggcgcgcgccgaggaaatgaagaagtccaagcaggccctctcgtcccgtccacagcctgctctcacccagaagaagcctggtccctagggccgncgcggtgattcccgcggcggcgctgctaacaagggcggctctggtgcccaagatgactctgatggtgacggctatggcaccatggacaccgtactcctggcaatgggtgccntcaggggcaagagatggcgtccgcaaggagattctctcatggccgcacctgtgtgtcaagggaaaggaaatggggcccctaatatgaaggggccctccatgtagtaaactccggagctacggccacacagaagaagggggcccctgacatggaacaagaaactgaccaacctgacctaagaaa

SEQ ID NO: 87531 - protein, 147 aa, Zea mays
  misc_feature: Ceres CLONE 1574612
  misc_feature (27)..(147): Pfam Name: SRP-alpha_N Pfam Description: Signal recognition particle, alpha subunit, N-terminal
MLEELLIFTRGGLILWSSCRALGAAALKGSPIDALIRSCLLEERSADASFSQDNYALKWTFHNDLGLVFVAVYQKILHLLYVDDLLAAVRKEFSQIYDPKRTSYDDFGDIFRQLHREAEARAEEMKKSKQALSSRPQPALTQKKPGP

SEQ ID NO: 87532 - DNA, 884 bp, Zea mays
  misc_feature: Ceres CLONE 1574613
  misc_feature: Translation starting site: 164
  misc_feature (296)..(296): n is a, c, t, g, unknown, or other
ctccccgcggtggcggccgctctagaactagtggatcccccgggctgcaggaattcgtctcacccctagaaaaaaacgacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggnattgggggtggcctgtaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctggggcgtcaccctcgctggggatctcggcggcggcgccctcctcgtctacaacacaagcgcctctccggctaaggatatcatgcatgcgcttcttgcgattcgtcatgtaaaatcaggtgtctgtctataatctagcctccatggatgcctcaaacctcgtcatgtaccaataatcagggctacccttccattactaatccccttcctagcattagcgaagagggggcaccgaaaaactaatggcgcgtccctttcggggccgggccccctctcccccccccgggggaatcgggaccaaccccacccccccttggttgtttccttccccgcgaataccggccccccccgggggggcgggcaatttggcggggaacctgtttttttggttccgcccccacccttttt

SEQ ID NO: 87533 - DNA, 945 bp, Zea mays
  misc_feature: Ceres CLONE 1574614
  misc_feature: Encodes the peptide sequence at SEQ ID NO. 87534
ctggagctccccgcggtggcggccgctctagaactagtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcacccgcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgccccatccctatggacggcacggaggggctcgtccgcggccagcgcgtcctcaacactggctcccccataccgtgcctgttgggcgggctacccttgggactattctttatgttttcgggggacccaatggatgaaaaagggggatttaacaccaaacactttcctccctatccatcgtgaagcccctgctttccttgaaccaggcactgatacccaaatttctggttacgggattcaaggtcgggggatcttcttgccccctatccaagagggggaaaaattgggccttttcggggggcgcagaatggggtaaaacgggcctctttggggagctataccacatgggttcttaaggcccagggggggttctctgtggtttgccggg

SEQ ID NO: 87534 - protein, 190 aa, Zea mays
  misc_feature: Ceres CLONE 1574614
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTRAGAIGQVCQVIGAVVDVRYDEGLPPILTALEVLDNDIRLVLEVAQHLGENMVRPIPMDGTEGLVRGQRVLNTGSPIPCLLGGLPLGLFFMFSGDPMDEKGGFNTKHFPPYPS

SEQ ID NO: 87535 - DNA, 940 bp, Zea mays
  misc_feature: Ceres CLONE 1574616
  misc_feature: Translation starting site: 160
aaagctggagctcaccgcggtggcggccgctctagaactagtggatcccccgggctgcaggaattcgtctcacccctagaaaaacttcgtgttccttcgcccgccgcacacgggatccatttgaccgatcgaccgacccacacacaccgagagccagccatggggcaaaaccacagcgcgcaggacgggagcggccacggccggcgctccttccagcagcagccgtcggcgcagtggggcgccggaggaggggggtactacgcccaggacccgaacgccggctactgcggcgcgccggtgccacaacagggaggagggtacgccgcgccttacctgcccccggcgtaccagtaccagcccaccgccgctgctccggcgccgcaagtcgcgaagcctcggcagctggaccggcggtactcgcggattgccgacgactatcactcggtggaccaggttactgatgctctagctcaagcaggacttgaatcatcaaatcttattgttggcgttgatttcacaaagagcaacgagtggacaggcaaattctctttccatggacgtagtctacatcacattagcaacacaccaaatccgtatgaacaagccatctcgattattgggcgaacactatcgaaatttgatgaagacaatttgattccatgtttcggaatttggagatgcatcaacacatgattcaagacgtctttctgtttctctcctgacgagagaccatgcaatggatttgaaagaagctcttgatcgatatagggaacttgtaccacatttgcgctttgctggaccaacatcatttgcgccaattattgaaaatggctacgaccatccgtggagcaaaggggccgggcaataccatggtcctattggataattgcaaaagggcaggtttacaaagaagtgtagaaacctgcatctgggacaggta

SEQ ID NO: 87536 - DNA, 831 bp, Zea mays
  misc_feature: Ceres CLONE 1574617
  misc_feature: Encodes the peptide sequence at SEQ ID NO. 87537
  misc_feature (74)..(74): n is a, c, t, g, unknown, or other
ctggagctccccgcggtggcggccgctctagaactagtggatcccccgtggctgcaggaattctgtctcacccnctagaaaaaaaaaaaaaaaaaaaaaaaaaaaaaaaaaaaaaaacctctcgtatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatccgcatgaccaatgtccgacctgtcaacacctcggtaccatcgcagttctggaccaggagttcatgaacccctgctgccgcgctgatgtgtcttgattgccagttcgggtcgtttttaattgcctacctgtgccaataaatttcgtgcccccagcccaccttaacaaccttccgggggggatccaaggggggggcggtcccggttccccgggaaccccaggggagacctttgggggggggcataaaaacaccgggtccccagggaaaaaaaccgggggggcccctgggggggggccccccccagggatcgtgggaaaaaaacccctcgttgttttttatattccccccccccccccggtggggtggtggaaaaacacccctgtgaggggtttt

SEQ ID NO: 87537 - protein, 105 aa, Zea mays
  misc_feature: Ceres CLONE 1574617
MASETETFAFQAEINQLLSLIINTFYSNKEIFLRELISNSSDALDKIRFESLTDKSKLDAQPELFIHLVPDKATNTLSIIDSGIRMTNVRPVNTSVPSQFWTRSS

SEQ ID NO: 87538 - DNA, 953 bp, Zea mays
  misc_feature: Ceres CLONE 1574619
  misc_feature: Translation starting site: 189
  misc_feature (751)..(751): n is a, c, t, g, unknown, or other
  misc_feature (814)..(814): n is a, c, t, g, unknown, or other
  misc_feature (896)..(896): n is a, c, t, g, unknown, or other
  misc_feature (918)..(918): n is a, c, t, g, unknown, or other
atagctggagctccccgcggtggcggccgctctagaactagtggatcccccgggctgcaggaattcgtctcacccctagaaaaaactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcctagaggttgggccggggccgcgggtctccgcgcccgtggactcggcgctccagctgaagacgatccccgcgcagcgccgggcggacttcgccgcgagcgggtccgtatgggctctgcgactacccaccgacgccgaattgcgccggttcagggtggagtacgagcgctgtcttttcgagacacgtacggagtggaagccacggacgaagggcggaaagangtgttcggcgccgaactcgccgcgtgggcgcggcctgccgaggccgacgacactgttttgggnccgacgcgaaggaaagcctcacccctcccgccgcagcaccagggaacgacctgctttaagaattccaaaggagaagcccgcnaacggcaacagcatccaaaganctcgcgcctgggggcggctgaaaaaaagcttcttt

SEQ ID NO: 87539 - DNA, 1088 bp, Zea mays
  misc_feature: Ceres CLONE 1574623
  misc_feature: Encodes the peptide sequence at SEQ ID NO. 87540
aagctggagctccccgcggtggcggccgctctagaactcgtggatcccccgggctgcaggaattcatctcacccctagaaaaagactcttgggttcttgcatcccgcataccctcgaaagatcgaaagatcccacggcgcagcagccacccttctctcctctgcggtcccaatcttatcgtcccctccctcgaagtcgccgatgccttcattccaccatggcgcttcacgccccggtacacgtgatgaaggactcgctgaaacgggagtctggcccgaaggttcaccaagccaacatccaggcagccaaagctgttgctgacatcattctgacgacatcgggtcccagatccttgccgaaaatgcttctggacgctggtggaggtattgtggttacaaatgaaggtaattctacctcgagggaaatagacatcgaacagcctggtaccgagtggacgatcgaactgaggcgtacacaatatgaagaagttgagtgatggcactacatgtgtcattgtttccagctagagagatgctgcacgttggcacacgcatcctttgacgaagactgccatatctaccgtttctttgtccgagcattcaccacatgcccattgattgatggcaattgcggggactttgacaaaagttgacaatgcccctgttgaatgttgaactgaatccgcggggagcaatgggcttaatcccctcattgaataaagcttcccacttggtgttacaataaattttacttgtgcgccagatatggggggaatcttatattggcttgaacccttggaaatttggatggcttgcaacaacgggccaggcggttgtacacttgggcccaggcgcatgcgtcgtaaggttttatttcaataaaatacactttaatgtgaaagatggttccggggttaccgacagggtcaaatgtaaaagaattccataaacccctcgtcagggggttctcattaaaaaaaagaatagttacgcgcccctcgttacaatgagagaaaatatcaattttatcccgcgcccttttatcgcgtgagaaagcgcgcgggtgagtttataaacaagcgaaaaaat

SEQ ID NO: 87540 - protein, 92 aa, Zea mays
  misc_feature: Ceres CLONE 1574623
MALHAPVHVMKDSLKRESGPKVHQANIQAAKAVADIILTTSGPRSLPKMLLDAGGGIVVTNEGNSTSREIDIEQPGTEWTIELRRTQYEEVE

SEQ ID NO: 87541 - DNA, 940 bp, Zea mays
  misc_feature: Ceres CLONE 1574624
  misc_feature: Encodes the peptide sequence at SEQ ID NO. 87542
  misc_feature (773)..(773): n is a, c, t, g, unknown, or other
  misc_feature (895)..(895): n is a, c, t, g, unknown, or other
  misc_feature (903)..(903): n is a, c, t, g, unknown, or other
tccccgcggtggcggccgctctagaactagtggatcccccgggctgcaggaattcgtctcaccccctagaaaaagctttcctttcccgttcaccccaagcccccaacctgcgagctgcgacaagttcgtctctctcgtggccacgactggccgccgcccccgcctccgtcccctcgcagattcccaggtcttcgccgctcccttcgccgccaaagagcacccactaggttaaatccgccagggggaaatctccatcaagtggctcgtgctaattatgcgatcttcatgggctgactcagttgcgaacgccgaggaatcggcgcccgcgactgctgctgctaatggctctgttgcaactcatagcacctcgcgccctacgcgcagctcctacgtgcctccacatcttcgtggccgctcagctggtgctgctgttgaagctcaagcaggcttagtagcaccagcacaaggtggaccactgccattggctgctgcacaaccttctggtcagggtgctgctgttggtggccctcgctgggctggcattgtgaatggtggttggtggtggtggcagcattggtgctcctcgccagggccatggtggcggaggcgggggccgtggtgcttggaactcccgtcctggtggttgggaccgcagagaccgggagccagatccgtttgcgatagccgaggctgaagaaattgatttcgacggccaggagaatactggcatcaattttgatgcctatgaagacatccctgttgagtacagtggncatgatgtgcctgcaccagtcaacacatttgcagaagatgatttgggtgatgcattgaatgacaatatccggaggtgcaagtatgtgaaacaacaacagtgcagcgttacgccatcccatcntcattgcntgggcggaatctcatgccctggccaagactggatcgg

SEQ ID NO: 87542 - protein, 130 aa, Zea mays
  misc_feature: Ceres CLONE 1574624
  misc_feature (116)..(116): Xaa is any aa, unknown, or other
  misc_feature (119)..(119): Xaa is any aa, unknown, or other
MVVGGGGSIGAPRQGHGGGGGGRGAWNSRPGGWDRRDREPDPFAIAEAEEIDFDGQENTGINFDAYEDIPVEYSGHDVPAPVNTFAEDDLGDALNDNIRRCKYVKQQQCSVTPSHXHCXGGISCPGQDWI

SEQ ID NO: 87543 - DNA, 932 bp, Zea mays
  misc_feature: Ceres CLONE 1574629
  misc_feature: SWISSPROT Homolog: EC 2.3.1.158 Phospholipid:diacylglycerol acyltransferase
  misc_feature (770)..(770): n is a, c, t, g, unknown, or other
agctccccgcggtggcggccgctctagaactagtggatcccccgggctgcaggaattcgtctcacccctagaaaaagcgaaccccacgaagccggagccaagccacgacgggtcgaccggtcgacggcccctcgacctgcccgcctcgcttcctccgacgcctagggttttctaccggacgccgccgccgccgcagcagcggcccgggatgcaggtgtgcccgcgcagttagccgccgtcggacccaccgccgccgcgcgccatgtcattcttgcggcggcgaaagccgctgccgccctctgacggtgacgagtccgaccacgacgactacgactaggggaagaagccgtcctcatcctccgggtcgccgtccaaggagcccacgaagcggaccaaggccaagtggtcgtgcgtggacagctgctgctggctggtcgggtgcgtgtgctccgcctggtggctgctgctctttctatcaacgcgatgccggcctcgttcccgcagtatgtcaccgaggccatcactgggccgctcccggacccgcccggggtcaagctgcagaaggaggggctggagttttagccaccccgtcgtcttcgtcccgggcatcgtcaccgggggcctggagtttatgggaggggcaccactgcgccgaggggctcttccgcaagcggctatggggcggcacattttggtgacgtatacaagagacctctatgctgggtcgaacatatgtcattggacaatgaaactggattagacaacctggnaataagggtcatggcggtcaacagcctggttgcagcagactatttggtccctggatattttggtttgggctgtcttattgccaatttagcacgtattggatatgaagaaaagacatgtacatggcgccctttggatgggaagttatcttcccgaaaaactgt

SEQ ID NO: 87544 - DNA, 925 bp, Zea mays
  misc_feature: Ceres CLONE 1574631
  misc_feature: Encodes the peptide sequence at SEQ ID NO. 87545
  misc_feature (654)..(654): n is a, c, t, g, unknown, or other
  misc_feature (674)..(674): n is a, c, t, g, unknown, or other
  misc_feature (829)..(829): n is a, c, t, g, unknown, or other
  misc_feature (830)..(830): n is a, c, t, g, unknown, or other
  misc_feature (837)..(837): n is a, c, t, g, unknown, or other
tggagctccccgcggtggcggccgctctagaactagtggatcccccgggctgcaggaattcgtctcacccctagaaaaaaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagagcgcgctcggccccgacgcgctgcgcgcgctcgttcctgaggtggaggccgccgtgcggtccactctcgcttcctgggacgcccggcacgtcagaagcacgntccacgccatgaagaccctntcgtttgacgtggggcatcgtgacgaatcttcggcggccggctggacgagtggcgcaagggcgagctgaagaagaaatactccgtcgtgggagagggggtacaactccttccccaacaacctgccggggacgctccattacaagccattcaagcnncgcggcngctgccacgcttgctgggcgacttcaggcgggaacgtcttgcccaagcccaaggcgggaccccgggcctgcttggctcccttaatggg

SEQ ID NO: 87545 - protein, 204 aa, Zea mays
  misc_feature: Ceres CLONE 1574631
  misc_feature: SWISSPROT Homolog: EC 1.14.13.93 (+)-abscisic acid 8'-hydroxylase
  misc_feature (176)..(176): Xaa is any aa, unknown, or other
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFFHQGDYHLRLRKLVQSALGPDALRALVPEVEAAVRSTLASWDARHVRSTXHAMKTLSFDVGHRDESSAAGWTSGARAS

SEQ ID NO: 87546 - DNA, 954 bp, Zea mays
  misc_feature: Ceres CLONE 1574632
  misc_feature: Translation starting site: 223
  misc_feature: SWISSPROT Homolog: EC 1.14.99.30 Carotene 7,8-desaturase
  misc_feature: SWISSPROT Homolog: EC 1.4.3.2 L-amino-acid oxidase
  misc_feature (884)..(884): n is a, c, t, g, unknown, or other
  misc_feature (903)..(903): n is a, c, t, g, unknown, or other
  misc_feature (935)..(935): n is a, c, t, g, unknown, or other
  misc_feature (949)..(949): n is a, c, t, g, unknown, or other
gctggagctccccgcggtggcggccgctctagaactagtggatcccccgggctgcaggaattcgtctcacccctagaaaaagaactgggctcccccgcctccacgacactgccccccgcctcaagtccgccgcctccattcttcagctctcctatcctccgtctgcctgtacctattggctgaagaagagctgacccccactttatcaagagttgctcaacaatggacactggctgcctgtcatctatgaatattactggagctagccaggcaagatcttttgcggggcaacttcctcctcagagatgttttgcgagtagtcactatacaagctttgccgtgaaaaaacttgtctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggacataaacccatattgcttgaggcaagagatgttcttgggtggaaaggtagctgcttggaaggatgaagatggagattggtacgagactgggcttcatatcttttttggagcttatcccaacatacagaatctgtttggcgagcttaggattgaggatcgtttacagtggatagaacactctatgatattcgccatgccaaacaagccaggagaaatcagccggtttgatttcccagaaactttgcagcacctataaatgggatatgggccatattgagaaccaatgaaatgcttacctggccccnagacgtgaagtttgcatcngactcctgccagacatggttggtggtcaaccntatgttgaactcangatgc

SEQ ID NO: 87547 - DNA, 823 bp, Zea mays
  misc_feature: Ceres CLONE 1574635
  misc_feature: Encodes the peptide sequence at SEQ ID NO. 87548
  misc_feature (396)..(396): n is a, c, t, g, unknown, or other
tagctggagctccccgcggtggcggccgctctagaactagtggatcccccgggctgcaggaattcgtctcacccctagaaaaaaccgaaccaaaccaacacacgtcaaagcagaaaacctcagaaaaccccaatatatcctcgtccaccactgcccccgctctgctgcaactccactcggcccggccgccctttccacccaccttgatcctccgatccgttggtgcttgaccgatccatggacacccacatcggatccgtgaacggggcggcgtctaaccagacggttggctgcccggcgtcggcgccggggtgcccgatggcgtccacgccggcgcagcccgcggcgaccctgtcggcgggggaggcgtcgctggagcgccacctcgcgcgtcgncctcgtgcaagtcggcgtcaacaacgtcttcgcggttccggggggacttcaaccctcacgcggctcgaacaacctgaatcgccaaaacccggtcctgccccctcggtgggggtgggtggaaaaaaagcttaaaacccccggggtttcccccccccaaaagggtaaaccccccccccccccggggtttctgggggcccggcccccctccccatttaaaaatgggggggggggcccacaaggggtctaaaaagcaccattcggggggggccccccacaaaaaaaaaaaaaccttgtggcgcctctatttttttatattccccgggggggggggccgcccaatatttccccaacaaaaaatattatgggggaggaaaaaacaaaatcgggggtatttctctctccccacaaaaaacaaatagattatggg

SEQ ID NO: 87548 - protein, 96 aa, Zea mays
  misc_feature: Ceres CLONE 1574635
  misc_feature: SWISSPROT Homolog: EC 4.1.1.1 Pyruvate decarboxylase
MDTHIGSVNGAASNQTVGCPASAPGCPMASTPAQPAATLSAGEASLERHLARRPRASRRQQRLRGSGGTSTLTRLEQPESPKPGPAPSVGVGGKKA

SEQ ID NO: 87549 - DNA, 963 bp, Zea mays
  misc_feature: Ceres CLONE 1574636
  misc_feature: Encodes the peptide sequence at SEQ ID NO. 87550
ctggagctccccgcggtggcggccgctctagaactagtggatcccccgggctgcaggaattcgtctcacccctagaaaaaacccaccaatccacagcgacacccgaccccgccgtcgtgatgaggccggcgctgctcaagtccacggccgagctcctccgccgcagccgcggctacgcctcctcggccaacccggagcggaaggtggccatcctgggcgctgcgggcggcatcgggcagccgctctccctcctcatgaagctcaacccgctcgtctcctccctctccctctatgatatcgccgggacccccggcgtcgcggccgacgtctcccacatcaactcccccgccctggtgaaggggttcatgggggacgaccagctcggggaggcgctcgagggctccgacgtcgtcatcatccccgccggggtgcccaggaagcccggcatgactagggacgacctcttcaacatcaacgccggcatcgttaaggggctctgcactgccatcgccaagcactgccccaacgctcttgtcaatatgatcagcaaccctgttaactccactgtcccgattgcggcggaggttttcaagaaggctggtacttatgatgcgaagaagctgtttggtgtgactactcttgatgttgttcgtgctaaaactttttatgctggaaaagcgggtgtgccagttactgaggtgaacgtacctggtgtttggaggccatgcggggtattactattctgccactccttctcgcagggcactcctggaaagcaattcttggtcccaagaaagacattgaggccctccaccaagaagaacacaagatggtggggaacagatgttggttgtaagcaaaggccgggaaaaaggctctgcaacgttggttcaatggcaattggcgtgggtgctggttttttgcaaaatgccatggttttgaaagggccctgaataggaaatt

SEQ ID NO: 87550 - protein, 277 aa, Zea mays
  misc_feature: Ceres CLONE 1574636
  misc_feature (27)..(170): Pfam Name: Ldh_1_N Pfam Description: lactate/malate dehydrogenase, NAD binding domain
  misc_feature: SWISSPROT Homolog: EC 1.1.1.37 Malate dehydrogenase
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDAKKLFGVTTLDVVRAKTFYAGKAGVPVTEVNVPGVWRPCGVLLFCHSFSQGTPGKQFLVPRKTLRPSTKKNTRWWGTDVGCKQRPGKRLCNVGSMAIGVGAGFLQNAMVLKGP

SEQ ID NO: 87551 - DNA, 737 bp, Zea mays
  misc_feature: Ceres CLONE 1574638
  misc_feature: Encodes the peptide sequence at SEQ ID NO. 87552
  misc_feature (707)..(707): n is a, c, t, g, unknown, or other
ggagctccccgcggtggcggccgctctagaactagtggatcccccgggctgcaggaattcgtctcacccctagaaaaactccgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatgggcgaccacgacgtcagcgtaccaccgccgcagcagcagcccgccaccaccgccaaagccgcggggggtccgtcgtcggcccttctgcccatagggtgggccgggcgggcgggcaaggcggggcctcccggggtggggggcgggggggaaccccccccccggtgtggggaagccccaaggggcccaggggccgtggggaaaaaaggggggggcaaagggttcccccccccccccccgaagaagagttttttaaaaaaaattacccccccccccccccgggggttctttttggagggaaaaaggggggggggcccccccctttacaccgttggtgaaaaaaaaaagcccccccccccccgggggggggggggggnaaaaaccaaccccgggggggggccccgccg

SEQ ID NO: 87552 - protein, 135 aa, Zea mays
  misc_feature: Ceres CLONE 1574638
  misc_feature (126)..(126): Xaa is any aa, unknown, or other
MGDHDVSVPPPQQQPATTAKAAGGPSSALLPIGWAGRAGKAGPPGVGGGGEPPPRCGEAPRGPGAVGKKGGGKGFPPPPPKKSFLKKITPPPPRGFFLEGKRGGGPPLYTVGEKKKPPPPRGGGGXKTNPGGGPR

SEQ ID NO: 87553 - DNA, 913 bp, Zea mays
  misc_feature: Ceres CLONE 1574640
  misc_feature: Encodes the peptide sequence at SEQ ID NO. 87554
  misc_feature (824)..(824): n is a, c, t, g, unknown, or other
ctggagctccccgcggtggcggccgctctagaactagtggatcccccgggctgcaggaattcgtctcacccctagaaaaaatacatacaccgttggcacgccatctaatcagcgaagaggagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaggagttgcatggttgattggctgggctttgatacttgaatacacgattggtggatcagccgttgcccgtggcatttctcctaatctagccttattttttggaggacaggatagtctgccatggattttagcacgacatgagatcccatggcttgatgtcgttgtagatccttgtgcttctttcctcgttttcgtcgtcactggccctctctgtgtggggataaaagagagtcatttgtgcaaagagttgtgacggtcttaaattgctttgnggatgttatttgttatcatagcccgtagctacatcggcttccaaacaagatggggttggctacaaggttgctgggcaaatttttcccct

SEQ ID NO: 87554 - protein, 190 aa, Zea mays
  misc_feature: Ceres CLONE 1574640
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGQDSLPWILARHEIPWLDVVVDPCASFLVFVVTGPLCVGIKESHLCKEL

SEQ ID NO: 87555 - DNA, 948 bp, Zea mays
  misc_feature: Ceres CLONE 1574643
  misc_feature: Translation starting site: 308
  misc_feature: SWISSPROT Homolog: EC 2.7.12.2 Mitogen-activated protein kinase kinase
tagctggagctccccgcggtggcggccgctctagaactagtggatcccccgggctgcaggaattcgtctcacccctagaaaaaatcatgccccgcagccccggcccctaccttttccttccgcttccctcccacccaccccacaccgcaagcccaaacaaaacgcaacgcgaaccagccacacgaatccaccagcgcacgcgcaccgtcacgcgagggggccttctcgccccgtccggacccccgcccgtcgccgtctctcccgtcgcgcgcgccacgcgaacggaacctaggcgaagcggcgcacgatgaggccgggcgggccgccgaactcgcgggcgctgcagccgccgggcacgccggggcggtcgcgccagcgcccggacctcaccctgccgctgccgcagcgggatctgacctccctcgccgtgcctctgcccctgcctaccccgacgtcgtgggggtagctgtcggagccggcgtcgctcggcgcgccgaacccgccgacctcggccggcgccgcgccgccgaacccggcgccgctgtgccagctggagcgcgtgcggagcgtcgggagcggcgcgggcgggactgtgtggatggtgcgccaccgccccacgggacgagactacgcgctcaaggtgctctacggcgacacaccacgactctgtgcggcggcagatcacgagcgagatcgcaatcctccgcaccggcaagcacacaggcgtggtgcgctgccacagcatgtacaagcatgccggggagctccagatcctgctggagtcatggaccaggggtcgctagagtaccgacgcatcggcgacggagcgctactagcgcacgttgcggtcatgtgctgtcggtcacgacttactgatcgtcagcacatgtgcacgagagatcgagccctcacctgatatcgatccggccgcggtcagatggcgaactg

SEQ ID NO: 87556 - DNA, 961 bp, Zea mays
  misc_feature: Ceres CLONE 1574645
  misc_feature: Encodes the peptide sequence at SEQ ID NO. 87557
acccgcggtggcggccgctctagaactagtggatcccccgggctgcaggaattcgtctcacccctagaaaaagcccccggtgagctgccactgccagcttccccgtgcgcgagctgtgctgctgctcggcggcgcgcccactccccggccgctccctcgtcactccgcctgccggtaatcggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccaaagcagcccgtcgctgttcgcatcaaggacctgctgggtcggatgactctcgccgaaaagatcggccagatgacgcacatcgagagggaaaacgccacggccgacgcgctggccaaatacttcataggtagcgtgctgagcggcggaggcagcgtgcctgctcctcatgcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtcgggctttggagctaccagggaccccggacctcgttaagataaattggagaagcaacttgctcttgaaagttagagctactggaaattccttacgcctttggctccctgttttagcgggtctgtagagatccaagatgggggacgttgcttatgagaccttcaggtgaaggatccagagggttgttccaggcacgtgactttaccccatctcttggccgggcaggtgaaggctccctgcgaattcccgcgggaaagcccttttgattgggggaaagttaaaagggttcctgcaaggcgccacaaccatattgccgggggatag

SEQ ID NO: 87557 - protein, 148 aa, Zea mays
  misc_feature: Ceres CLONE 1574645
MASVHKATTLVLMFCLLALGRAEYLKYKDPKQPVAVRIKDLLGRMTLAEKIGQMTHIERENATADALAKYFIGSVLSGGGSVPAPHASAQAWAAMVTEMQKGALSTRLGIPIIYGIDAVHGHNNVYKATIFPHNVGLWSYQGPRTSLR

SEQ ID NO: 87558 - DNA, 979 bp, Zea mays
  misc_feature: Ceres CLONE 1574646
  misc_feature: Encodes the peptide sequence at SEQ ID NO. 87559
  misc_feature (245)..(245): n is a, c, t, g, unknown, or other
ctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcntgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttgaccacagcattgaggacgttcgacctgccggaggcgtgaagaagttccagtctgctgcttactcccactgcgcgaagatgccatcctgatatcccttttggcttcctcattctagtaggttaggatttccttttctgaccctttgattcgtaccaatctctctgggccggttgcttcccgaataatcacccattttcccctttctaggtccttttgaaattctttccttcctcccattctcaaagcatttggttttttgtgattcccccgtgctcccaagggcttgttccttttcgggctgggtgaaggccttcccccgggttttatgattttcggggtctagaggggcttttagaaaaacgccctttgtaataaaatttcctctaaaggaacttctctttttgggatcccccttggggcgggtggtttgcccgtgtcttcttccgaggccaacttaatatccctgcttttgtatctgtcctgtgtgcatatttgttctctaccctccccctatttttttccttttgtgtctgcttttccacacgatttgtgggccgtttcctctcataatcgttaccgaatccttc

SEQ ID NO: 87559 - protein, 50 aa, Zea mays
  misc_feature: Ceres CLONE 1574646
  misc_feature (1)..(50): Pfam Name: AdoMetDC_leader Pfam Description: S-adenosyl-l-methionine decarboxylase leader peptide
MESKGGKKSSSSRSMMYEAPLDHSIEDVRPAGGVKKFQSAAYSHCAKMPS

SEQ ID NO: 87560 - DNA, 912 bp, Zea mays
  misc_feature: Ceres CLONE 1574648
  misc_feature: Translation starting site: 107
ggagctccccgcggtggcggccgctctagaactagtggatcccccgggctgcaggaattcgtctcacccctagaaaaaaggaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgccaaggatcttgggattgctgaaaatgctgtcttgcagggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtaccccttacatatctgagatctcaccaactgaattcgtggaacactttggtaccgttatcaacttttatttgcattggattcttgcagctttgttagctgggatgcctctgggcagaaatcctgcctggtgggagacatgtttgggaatgcctgtagtccatcattctgctgg

SEQ ID NO: 87561 - DNA, 977 bp, Zea mays
  misc_feature: Ceres CLONE 1574651
  misc_feature: Encodes the peptide sequence at SEQ ID NO. 87562
  misc_feature (444)..(444): n is a, c, t, g, unknown, or other
  misc_feature (446)..(446): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (473)..(473): n is a, c, t, g, unknown, or other
  misc_feature (540)..(540): n is a, c, t, g, unknown, or other
  misc_feature (567)..(567): n is a, c, t, g, unknown, or other
  misc_feature (568)..(568): n is a, c, t, g, unknown, or other
  misc_feature (593)..(593): n is a, c, t, g, unknown, or other
  misc_feature (597)..(597): n is a, c, t, g, unknown, or other
  misc_feature (601)..(601): n is a, c, t, g, unknown, or other
  misc_feature (602)..(602): n is a, c, t, g, unknown, or other
  misc_feature (646)..(646): n is a, c, t, g, unknown, or other
gctggagctccccgcggtggcggccgctctagaactagtggatcccccgggctgcaggaattcgtctcacccctagaaaaagtggccgcgcgagccgcgaggagccagccagccatcagccatggtcgtcccagtcccgccgccgcctctcctcgcttcccacgtggccgtccgggccgcggcctccgccatatcccacggccgccgggtcctccttaacggcgaccacccgccgcaggtcgcggccctcgggcgcggcgactgggtcaagctcatctgcggcgccagctttgaggtaccatgccccttccaccttgctgcttcactcgtcactacattgggcaccaactccagcctccaggtactgttggctgtgcatagtagggtcaaatggggctccagggactattggctgtgcaacctgtggaggtgaaatgctggtgngngttggnnntgttttgatgtgctaccancagtaaagagtacccagtgtaccacgatgcaatagggcacaaaagagtgaaggaactatttactganctggaccgtgttataatccctcacatnncgtttacatggttcatttgtccttngcangganntgcagctgaatgtcagggaaatcttctcccctttgtctacactncccttggcctgggaaatgaatttgggcatttgattggtgcagccagatggccatctggtgggtgggagccagtgaatgaaaagggtatttgaaagtacccagcttcaatttggtccaaacaagtccaaaggccttggccggatgaataaagggttaatggaggaattgcaaaaaaccttcatttccggtaaaccgaaatttgaacccggaaaaattggcccctggtttggcccaaaaccccttgggaaaaattttcccccccgaataaaaattccaaaaaaaccccccggggttttggggaagggccaattgtgggccccccgggggaaaa

SEQ ID NO: 87562 - protein, 103 aa, Zea mays
  misc_feature: Ceres CLONE 1574651
MVVPVPPPPLLASHVAVRAAASAISHGRRVLLNGDHPPQVAALGRGDWVKLICGASFEVPCPFHLAASLVTTLGTNSSLQVLLAVHSRVKWGSRDYWLCNLWR

SEQ ID NO: 87563 - DNA, 958 bp, Zea mays
  misc_feature: Ceres CLONE 1574654
  misc_feature: Encodes the peptide sequence at SEQ ID NO. 87564
ccgcggtggcggccgctctagaactagtggatcccccgggctgcaggaattcgtctcacccctagaaaaagccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctgggaggtgttcagctccttcgcaaggggctacgtcgtccacgccagccccagggtcaggttccaagcctttcgccagggcctttcctcggggccaaaaaagtcttccgggaccaaactgggaaggccgcagggacggaaaggccccgggcttcttgggccaggcccagcgttgctcgtcgggaaaccccaaaaataaaggccctcccttaaaggagttggggaaacccctgcccaaaattgggttgggggaaaagggaaaacaaaactcacatttttggccccctggaaggggcgcaacccggggagaccaagaaaaaaaacccgtgggccaaaaaaccttggttaccccctttattgtgcaaagagccccccttgtaaacccaaaaccctcttagggggggaactcttcttgaggggggttgttttccccggggccttaggggtaataaaaaccgcgccccaccccc

SEQ ID NO: 87564 - protein, 178 aa, Zea mays
  misc_feature: Ceres CLONE 1574654
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWEVFSSFARGYVVHASPRVRFQAFRQGLSSGPKKSSGTKLGRPQGRKGPGLLGPGPALLVGKPQK

SEQ ID NO: 87565 - DNA, 1002 bp, Zea mays
  misc_feature: Ceres CLONE 1574655
  misc_feature: Encodes the peptide sequence at SEQ ID NO. 87566
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (446)..(446): n is a, c, t, g, unknown, or other
  misc_feature (587)..(587): n is a, c, t, g, unknown, or other
ctggagctccccgcggtggcggccgctctagaactagtggatcccccgggctgcaggaattcgtctcacccctagaaaaagtcaagaacggcaagacggtcgcgaccatcgtgggtgccaggaaggacgagctcctggcccagatcgagaagcatgccgcgcctgcgcctgcgtctgcgtctgcctaaaggagatcagtcgtcgccgtcaataagggccagcacgtatggctgtaaatgttgtcgttatcagttctggctttgtcgtttgtgggcgattgtgaactagtagtatgtttgtttctatccgagccggaggcgatacttaaccaaaannnnnnnnnnnnnnnnnnnnnnnnaaaaagcaaaagctgctcatcaccgatggccacggctaacacaagcaagcaagcaagtcactgagtagctagcagtatataccaccantaaaaacaccacacacacacgtgcgctaataagctaaagcttaggtagctcctctctatctccggctagctcggacgggagaacgttgccatgggctgctcaactgcatcacgcactataacgagctgctgcacaaagaancaggaagcgaaacgagggctgctggttcgggatcccccttttccttggtggtccttgccgtccgtggtcgttaccttgggggggttggggtttgggtttcggggttcgggaaaaaaaaacaagggaccgggggggggggggggccaaaaaccccaaaaatcttttagaactggtggcctccccccccttataacccccccttttgggggccccgccccctttggggggagacccccctggtgtgccccccgccggccctcccacagtgaggcccgaaaatgtttgtgtgtccccccgggcgcgggagaaaaggtggggggtccttcccccgccggccccaaagagggggtcccccacacaaaaaacattttttttccccccccccccccccggggtgagaaaaaatatgaagggg

SEQ ID NO: 87566 - protein, 61 aa, Zea mays
  misc_feature: Ceres CLONE 1574655
GAPRGGGRSRTSGSPGLQEFVSPLEKVKNGKTVATIVGARKDELLAQIEKHAAPAPASASA

SEQ ID NO: 87567 - DNA, 889 bp, Zea mays
  misc_feature: Ceres CLONE 1574659
  misc_feature: Encodes the peptide sequence at SEQ ID NO. 87568
  misc_feature (850)..(850): n is a, c, t, g, unknown, or other
  misc_feature (872)..(872): n is a, c, t, g, unknown, or other
acccgcggtggcggccgctctagaactagtggatcccccgggctgcaggaattcgtctcacccctagaaaaagtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgctctgttcactgcactctttagcactgtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctggctgcatcaagtggacttgtggttctgtacatcacaattaatgtatttaagttgtattacggtgatgaactgggagggtctttttgagccatcactggctatgggtcttggntgggcgtccatggctcctctcngaaagaagtggtggaga

SEQ ID NO: 87568 - protein, 220 aa, Zea mays
  misc_feature: Ceres CLONE 1574659
  misc_feature (6)..(221): Pfam Name: H_PPase Pfam Description: Inorganic H+ pyrophosphatase
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLAASSGLVVLYITINVFKLYYGDELGGSF

SEQ ID NO: 87569 - DNA, 918 bp, Zea mays
  misc_feature: Ceres CLONE 1574662
  misc_feature: Encodes the peptide sequence at SEQ ID NO. 87570
ctccccgcggtggcggccgctctagaactagtggatcccccgggctgcaggaattcgtctcacccctagaaaaatgctgaaactattaacgacgcagttgaatttgttcttcagaatttcatagaaatgaacaaactctgggttcggatgcaacatctggggcctgcccgagaaaaggaaaagcgtgggaaggaaagaaatgaactgcgtgatctggtaggcaaaaaccttcatgttctaagccagattgagggtgttgaccttgatatgtacaaagaaactgttcttccaaggatattagagcaggtggttaattgtaaggatgaccttgcacagttctacctgatggactgcataatccaagtctttccagatgaataccatttacaaacaccccaaacattattgaatgcatttccccagcttcagccaaggtgttgatatcaaaacaggtactctctcgacttatggacagattgtctaactatggctgcctcaagtcctgaaagggttaccccggagttcctttgcaagttggaaaacttttggctaagattcacgtaatgcctattgggaaagggtgattgaaagccccaacccggaccttgtccatgtggtttgggagcccccaaacccttaatagggttttcgctgtttggagctttttaacccctcccggggtaaagcccggaaccgggcgttggattttgtttgaacccaagtggctccgggggcccttgtgtttaagaaaaatctttccgggccaaagcgaaatatttttaaaaaatagcagggggtcaacaaagaaaaaatgggtgggcgccttttaaggggggcccccccgtagaaaagaatagtgacaattgtttttccccgggggtataaaaaatattaaaacaaatctcccggtgcgagggg

SEQ ID NO: 87570 - protein, 104 aa, Zea mays
  misc_feature: Ceres CLONE 1574662
MNKLWVRMQHLGPAREKEKRGKERNELRDLVGKNLHVLSQIEGVDLDMYKETVLPRILEQVVNCKDDLAQFYLMDCIIQVFPDEYHLQTPQTLLNAFPQLQPRC

SEQ ID NO: 87571 - DNA, 876 bp, Zea mays
  misc_feature: Ceres CLONE 1574664
  misc_feature (275)..(275): n is a, c, t, g, unknown, or other
catagctggagctccccgcggtggcggccgctctagaactagtggatcccccgggctgcaggaattcgtctcacccctagaaaaaaaaacggcttttaactaattccacctcctctctctctccccgatccagctagcctgacctcccaccctccctcttgaatccgctcaagttcccgatctcccaccttgtcctccagctcgatcgcgttcgcggcaccccactccgtgctccagaaataagtagccggcggtttcctcgcccaggttttgcngttgctggggagtgggaattcgtcggctccggtctggccaatgctcctgcggtttcttgtagaagccgctgaaaatggggatcccaactgccttaaggcgaaccacaccagtacccccctccaaaattccccctcctttttcgaaaggattcccccgttccttgggcggggaattctgggttgcgggggaaaaaaaaaaaaatttttttcccgggatggggccccaaccccccgggttgacccggggaaccccttaaaaaaggcccccccccttttttttttaggggagcccttttcaaaagggttttttttttttgccccccaaaattttttccccccccccatttttttttttaaaaaaaaccacgcggggaataaaaaaaaaaaaagggtttttggagcccccccccccccggaaagaaacccccccctccttccgggggggggggggggcccccccggggggtttcccctatgggggggggtttttccccccaagggggtggagggggggcccccccctctctgggggggggggcccccccacaaaaaagggggggggggttaaattccccccctccgggcggggggaacccccccc

SEQ ID NO: 87572 - DNA, 909 bp, Zea mays
  misc_feature: Ceres CLONE 1574666
  misc_feature: Encodes the peptide sequence at SEQ ID NO. 87573
  misc_feature (477)..(477): n is a, c, t, g, unknown, or other
  misc_feature (479)..(479): n is a, c, t, g, unknown, or other
ctggagctccccgcggtggcggccgctctagaactagtggatcccccgggctgcaggaattcgtctcacccctagaaaaaattttttggcagcacgcccacacagcagcatcaacctcgggtgctctgcggccactggactgccctgccagtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgaacattggcatctcagggagtgtgtcggagatggaggattncntgaacaagttcctcccccgggttgctcaagaagaccgcgcgcggcaacaaggacgtgtactgcatttacaacaccagggcgctgaaaggccttcacgtcgtccctttaacccttttcgaatggtgggggaaaccttctgtggaaaccccctggaaccccgcggcttggggggggcaaggcccttatattctaatcggggggggggccttgtttttttggccgggggcccctctttaaaaccgccccgggggcaaaaattcccatttgttttttttttggggaaaaaaacttccccccgccctggggggttggtttttttcggggcaggggcccaccgccgggtttctctcccccaaagaggggcccccccccgccgtgggggggaggggggttttttttttgggggtctctcccccccttttttataggc

SEQ ID NO: 87573 - protein, 84 aa, Zea mays
  misc_feature: Ceres CLONE 1574666
  misc_feature (56)..(56): Xaa is any aa, unknown, or other
  misc_feature (57)..(57): Xaa is any aa, unknown, or other
MPGGAFLLNGSGGGMADYGGGLTVPVVVTCLMAASGGLIFGYEHWHLRECVGDGGXXEQVPPPGCSRRPRAATRTCTAFTTPGR

SEQ ID NO: 87574 - DNA, 821 bp, Zea mays
  misc_feature: Ceres CLONE 1574669
  misc_feature: Encodes the peptide sequence at SEQ ID NO. 87575
  misc_feature (609)..(609): n is a, c, t, g, unknown, or other
  misc_feature (641)..(641): n is a, c, t, g, unknown, or other
  misc_feature (682)..(682): n is a, c, t, g, unknown, or other
  misc_feature (714)..(714): n is a, c, t, g, unknown, or other
  misc_feature (715)..(715): n is a, c, t, g, unknown, or other
ctggagctccccgcggtggcggccgctctagaactagtggatcccccgggctgcaggaattcgtctcacccctagaaaaaaaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatggggttcacggaggagttcctgcggcagatggagccgcggatgcagcaggccttcgtcgacatgcgggagctcgagaagggcgccatcgccaaccccgacgagggtcgcatggtgggccactactggnctcgcgacccggccctcgctcccaactccttncctcggaaacagatcgagaccgcactcgacaaaatcctcgncttctccccagatgtcatctctggaaaagatnncttccccatctgggtcgttcacttcaattctctctatagaattcggagggtcagctttggggccctccaattggttgcgaaggcacttgcacctgaataccctccc

SEQ ID NO: 87575 - protein, 214 aa, Zea mays
  misc_feature: Ceres CLONE 1574669
  misc_feature: SWISSPROT Homolog: EC 5.3.1.9 Glucose-6-phosphate isomerase
  misc_feature (144)..(144): Xaa is any aa, unknown, or other
  misc_feature (154)..(154): Xaa is any aa, unknown, or other
  misc_feature (168)..(168): Xaa is any aa, unknown, or other
  misc_feature (179)..(179): Xaa is any aa, unknown, or other
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWXRDPALAPNSXPRKQIETALDKILXFSPDVISGKDXFPIWVVHFNSLYRIRRVSFGALQLVAKALAPEYPP

SEQ ID NO: 87576 - DNA, 818 bp, Zea mays
  misc_feature: Ceres CLONE 1574676
  misc_feature: Encodes the peptide sequence at SEQ ID NO. 87577
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (500)..(500): n is a, c, t, g, unknown, or other
aagctggagctcccgcggtggcggccgctctagaactagtggatcccccgggctgcaggaattcgtctcacccctagaaaaagctccatccccccctctccacactgccaactcgctccgaagaaagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccagcgaggagctgcccgtcatgccctgggncannctccgtcgcagcggttacacccttttgagggatccacacacaacaagggtcttgctttcacagagggaggaagggatggaccctacttgntgtgactgcttcctccggcagtactttctcgggacttcaaattaaaaatttctgaaacccctgggggagtacccgacccctttgcagcgggttttacctttgtgaacctttcgggaaacggccaaaaggttttttcccaacttttaaatgaaaaagggggggggacccgcttctctttttttttcccccccccctgtgggggggcgcctcccaaaaaaaagggggccccctttttggggaaaaccccagggggggttttttgttccccccccgaaaggagaaagggggaaggggccctccaaaaattttttggagggg

SEQ ID NO: 87577 - protein, 110 aa, Zea mays
  misc_feature: Ceres CLONE 1574676
  misc_feature: SWISSPROT Homolog: EC 1.1.1.40 Malate dehydrogenase (oxaloacetate-decarboxylating) (NADP(+))
  misc_feature (65)..(65): Xaa is any aa, unknown, or other
  misc_feature (66)..(66): Xaa is any aa, unknown, or other
  misc_feature (96)..(96): Xaa is any aa, unknown, or other
MLSTRTAAVAASASPASPWKLGGRSEGGASCDGCRTYRNTLRRRAAPAKVRALPPSEELPVMPWXXLRRSGYTLLRDPHTTRVLLSQREEGMDPTXCDCFLRQYFLGTSN

SEQ ID NO: 87578 - DNA, 898 bp, Zea mays
  misc_feature: Ceres CLONE 1574680
  misc_feature: Translation starting site: 364
  misc_feature (800)..(800): n is a, c, t, g, unknown, or other
  misc_feature (829)..(829): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
ctggagctcaccgcggtggcggccgctctagaactagtggatcccccgggctgcaggaattcgtctcacccctagaaaaagtctcctcccccccacttgcacttgcgaccgcgcgcgagcagcagcgacgtcccctttttcctagaggaagcagccacagcccactgagctcgctcgcgcgcgctagctacctacgcacatatctagcagctactacctagccagcagcagctacagccgcgctcgccgaggccggggcacagagggtactacaaagatatgcggaggcagcagccgaggccggggcagcagcggcggtagacgacgacgacgcacacggacgcgcgcggtcgatcggctatcatgagcggcggcaggcacgagaacgggcacggcggcgcggcggctgcaggtggaagcggaggaagcagcgacgcgcacgaggacgacctggtgatgccgggcttccggttccaccccacggaggaggagctcatcgagttctacctccgccggaaggtggagggcaagcgcttcaacgtcgagctcatcaccttcctcgacctctaccgctacgacccatgggagctcccagcaatggccgcgattggggaagaaggagtggtacttctacgtgccgagggaccgcaagtaccgcaacggcgacaggcccaaccgtggtgacggcgtcgggctactggaaggccacgggcgccgaccgcaccatcaaggcggacaacagccgccccatcgggctcaagaagacgctcgtcttctactccggcaaggcgcccaaggtncgtcgcagcagctggatcatgaacgagtnacgcnnntccgccgacgacaccgtacgctacactagaccgaatattccctcttgcgcgtggtatagcgc

SEQ ID NO: 87579 - DNA, 1271 bp, Zea mays
  misc_feature: Ceres CLONE 1574682
  misc_feature: Encodes the peptide sequence at SEQ ID NO. 87580
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (933)..(933): n is a, c, t, g, unknown, or other
  misc_feature (964)..(964): n is a, c, t, g, unknown, or other
  misc_feature (988)..(988): n is a, c, t, g, unknown, or other
  misc_feature (1058)..(1058): n is a, c, t, g, unknown, or other
  misc_feature (1271)..(1271): n is a, c, t, g, unknown, or other
tgatttgttttggaaagtatatacttaaaaagcgacccagatttggttggagggagcggttttttatnnnnnntcaaactggagctcaccacggtggcggccgctctagaatagtggatcccccgggctgcaggaattcgtctcacccctagaaaaatcctcctcccgctccccctggctccccaagcctcgacgcccggctagggttttgcctccttcccgccgccgctgtttcagcgagcgagaccgaggggtagagaaagagcggtgcttagccacccatgtcgctgcgtccaagcgagcgggtcgaggtacggcggaaccgctacaaggtggcggttgacccggatgacgggcggctgcggcacaaggacaatatggtggagatccgcaagagccgccgtgaggagagcctcctcaagaggcgccgtgaggggctccaagcctaggtccctgcccctccctccgggggcccacacaagcttgaaagcctcccagctatggttaggggggtttatttcggatgataaataacccttcgagcttgagggccgccaccacaggttccggcataattgcctctcttcaaggagagggaggcccccccattcgaaaaaaggttatccaaaaccccggtgttagattcccaaagattttgtgggcggtcccctctcaccccataaataggaaatttcccctccctcggctgtacacattattagaaagccttcctaatgggggcctttctatcacagaaaaaaaagttgcgcttattcaggggggccctcttcttctgacaataaatatcacacaaagggtgttttatttatatttggagacatcaaagaggggaacgcagacggatacacctcatagtgatatatgagcggagaagaaaactattctctctttgagagtgaatcgcggcgtgantcatactaacagagttatgttctcccacaanagataacacacgcacacacttggngcttttgggaactcctttttatgcatgtctcatatagtagcgcgctgtgtggtgtatatttaaacccacnccctataagtgtcgtcgcgcgcatatatctcgtgtgttctctctactcgccaagattgtgtaggtcgctgctataaaatagctacctctctcgctcttttgtcgccgatcacgttgattatgagagtagtacggttttgttaaaatgttgctccctcccatctgaggatggaaatgagcagagctctcgcactgcgtgaggagtgattgatan

SEQ ID NO: 87580 - protein, 55 aa, Zea mays
  misc_feature: Ceres CLONE 1574682
  misc_feature (4)..(55): Pfam Name: IBB Pfam Description: Importin beta binding domain
MSLRPSERVEVRRNRYKVAVDPDDGRLRHKDNMVEIRKSRREESLLKRRREGLQA

SEQ ID NO: 87581 - DNA, 1173 bp, Zea mays
  misc_feature: Ceres CLONE 1574683
  misc_feature: Encodes the peptide sequence at SEQ ID NO. 87582
  misc_feature (909)..(909): n is a, c, t, g, unknown, or other
  misc_feature (1008)..(1008): n is a, c, t, g, unknown, or other
  misc_feature (1053)..(1053): n is a, c, t, g, unknown, or other
aaactggagctccccgcggtggcggccgctctagaactagtggatcccccgggctgcaggaattcgtctcacccctagaaaaaatccacaccccggtcggctagtcccaaggctgctgccgccgcctgccgctaggggatcgcttgctttcctcggaccactctgccgaccacatctacaccgcatcaacggtccttccaagtgagctccaatcccctgtctgtagatggagagggtgctaaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgtgactgttacaaaccacccccctaccaattttgaagtcacttcacattgaaaatccctgctgccaaaggtccttgttgacatctccaaaagttcaagaagaacgaaagttggtgatgggaacaaccttctggttggttggtcccaagcgggagaaactttttgaaaggtaaggcgaaaaaagtttattttaacagggaaaaatttccttcccaattgacatttttttgtgccacggtttcaaaaaaagggggtctctccaagaggtggccccagaagaatttcttttgttgcctaaaaaaagagacccctgggggctcactcccagggagaaaatatcgcggagaataaaatcctccgcaatacccgggatacctcgcaaagaaaaatatgtgggcgttgagagaaacaccccctaggtagtgtgtcaacaaaatactatttttctcccataaaaaaaagaagagggaaattttccccctatataaatttcagagattgaatatctctctactttgggagcgnttaaatggtgtgcccccccccaccgtggaagatcttctcttactctctcgaaaaacacaaccgtggaggagttccttcgagggggagcctctcttggtnggaaagagaggtttctatctgcgaaggaaaattacgtggtttggngcacgccccgcccctacgagatgacgcaaatttgtgtgcgcacattgttttgggagcaaaatataaatttttggcccgccgcgcgcgggtgtattattcagggagtattatatatcgccg

SEQ ID NO: 87582 - protein, 69 aa, Zea mays
  misc_feature: Ceres CLONE 1574683
MERVLKDDAVEEKGERARMASFVGAMAISDLVKTTLGPKGMDKILQSTGRGRNVTVTNHPPTNFEVTSH

SEQ ID NO: 87583 - DNA, 942 bp, Zea mays
  misc_feature: Ceres CLONE 1574684
  misc_feature: Encodes the peptide sequence at SEQ ID NO. 87584
  misc_feature (383)..(383): n is a, c, t, g, unknown, or other
  misc_feature (800)..(800): n is a, c, t, g, unknown, or other
  misc_feature (834)..(834): n is a, c, t, g, unknown, or other
  misc_feature (909)..(909): n is a, c, t, g, unknown, or other
tccccgcggtggcggccgctctagaactagtggatcccccgggctgcaggaattcgtctcacccctagaaaaagcgacccccttccccctgacgcctcgcgaagccatcatcttccaaaccctcgccgcagccgcagccgcagccgcagccacccttgcttccgcacgatagtgcccgggaccagccttctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttattgggattgatttggggacaactaactcnttgtgttgctgttatggaaggaaagaacccaaaagttattgagaatgctgaaggtgcgagaacaacaccatctgttgtcgcatttactcagaagggtgaaagacttgttggtactccagccaagcgccaggcagtaaccaatccccagaatactttctttggaacaaagaggatgattgggcgacgctttgatgatccacagacacagaaagagatgaagatggtgccatacaaaatcgtgaaggctccaaatggtgatgcttgggttgaaacaacagatggcaagcagtactcaccgagtcaaggcggtgcatttgtgctgaccaagatgaaagagacagctgaatcttactttggcaaatcagtctcaaaggcagtggatactggtccaagcctattcaatgatgctcagcgtcnaggccacaaagatgcttgtcgcattgctggcccntgatgtgaaggatcatcaatgaacctacagcagctgctctgtcttatggatgaaacacagggaaggctgatagcngttattgatcctgggaggaggacttttgaatta

SEQ ID NO: 87584 - protein, 163 aa, Zea mays
  misc_feature: Ceres CLONE 1574684
  misc_feature (13)..(13): Xaa is any aa, unknown, or other
  misc_feature (152)..(152): Xaa is any aa, unknown, or other
MRLLGLIWGQLTXCVAVMEGKNPKVIENAEGARTTPSVVAFTQKGERLVGTPAKRQAVTNPQNTFFGTKRMIGRRFDDPQTQKEMKMVPYKIVKAPNGDAWVETTDGKQYSPSQGGAFVLTKMKETAESYFGKSVSKAVDTGPSLFNDAQRXGHKDACRIAGP

SEQ ID NO: 87585 - DNA, 752 bp, Zea mays
  misc_feature: Ceres CLONE 1574686
  misc_feature: Encodes the peptide sequence at SEQ ID NO. 87586
  misc_feature (324)..(324): n is a, c, t, g, unknown, or other
  misc_feature (330)..(330): n is a, c, t, g, unknown, or other
  misc_feature (343)..(343): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
aaactggagctccccgcggtggcggccgctctagaactagtggatcccccgggctgcaggaattcgtctcacccctagaaaaaaaattttgccgtcaaatctgtcaactccaactgctcggcacctccattcggcgcaggcgctcggttggctcctctccgtgcccggcgcttctgggcaccgtcctcgaggtcgtcgtgccatactctagggcctccatggcgcagctccttggcaagatgcccctgcaattcactagcaagcaggctgcagaggacatggcactggccgcatacaatcgagcactcaagctttctggaccangtctgncagtatgggtgtnggatttactgggtcactggcgagctcacgtccaaaacatggtgacaccaggttttacttgtcaacaatggacacataatttggctcagggaaatccactgtttaacctttttccaaaggggttttccggaatttgggggagggaaaaaaaaaaaaaagggtttcaagccctttttttttttgtttaggggggaaaaagggcaaaaaaccccgggggagaaattttttttccccacacatattttttggcggnnnaacaatttccccccaaaattctggaaaatctccccaaaaaaaaaaaaatctgtggggagaaaaaattttgttgtgggaaaaaaaaaaaaaaaaaacccctcccccccgggagtttgtttttttattttgggggggcgcccaaatattttttcttt

SEQ ID NO: 87586 - protein, 175 aa, Zea mays
  misc_feature: Ceres CLONE 1574686
  misc_feature (108)..(108): Xaa is any aa, unknown, or other
  misc_feature (110)..(110): Xaa is any aa, unknown, or other
  misc_feature (114)..(114): Xaa is any aa, unknown, or other
TGAPRGGGRSRTSGSPGLQEFVSPLEKKFCRQICQLQLLGTSIRRRRSVGSSPCPALLGTVLEVVVPYSRASMAQLLGKMPLQFTSKQAAEDMALAAYNRALKLSGPXLXVWVXDLLGHWRAHVQNMVTPGFTCQQWTHNLAQGNPLFNLFPKGFSGIWGREKKKKGFQALFFFV

SEQ ID NO: 87587 - DNA, 875 bp, Zea mays
  misc_feature: Ceres CLONE 1574689
  misc_feature: Encodes the peptide sequence at SEQ ID NO. 87588
ctggagctcaccgcggtggcggccgctctagaactagtggatcccccgggctgcaggaattcgtctcacccctagaaaaactccgcaatagcccgtccccgccgccggattcgatcccgtctccggccgacgcgaccatttcccgcaccgccagatcctctcggctcggcccggccgccgcgcacctcccgcaattacagcgaccgcaataccagcaacgcctcctccacaaacggggcgggccgaggatccattcagccagtccacgcctttgactcgcactccgtttccagatctaggcgggcgggccgaggaacgatggacggagtctccgccccgccgccccaccggcggctgccggacttcctccagagcgtgaacctcaagtacgtgaagctggggtaccactacctcatcacccacctgctgacgctgacgctgctgccgctgatcgccgtgatcctgctggaggccgggcgcaccgacccggacgacctgcgccagctctggctccacctccagtacaacctcgtgtccgtgctggtcctctccgccgtgctcgtgttcggcgccaccgtctacgcgctcacccgcccgcgccccgtctacctggtcgacttcgcctgctaccgcccgcccgcgcacctccgggtccgcttcgaccagttcatgcgccactcccgcctctgcggcttctccgacgacgcgctggagttccagcgcaagatcctggagcgctcgggcctcagcgaggagacgtacgtccccgaagtcatgcacgcgctcccgccccatgccactatggccaacgcccgcgccgaagccgaaggcgtcatgttcggcgcgctcgacgccctcttccgctccagggcgtt

SEQ ID NO: 87588 - protein, 185 aa, Zea mays
  misc_feature: Ceres CLONE 1574689
  misc_feature (88)..(185): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MDGVSAPPPHRRLPDFLQSVNLKYVKLGYHYLITHLLTLTLLPLIAVILLEAGRTDPDDLRQLWLHLQYNLVSVLVLSAVLVFGATVYALTRPRPVYLVDFACYRPPAHLRVRFDQFMRHSRLCGFSDDALEFQRKILERSGLSEETYVPEVMHALPPHATMANARAEAEGVMFGALDALFRSRA

SEQ ID NO: 87589 - DNA, 990 bp, Zea mays
  misc_feature: Ceres CLONE 1574692
  misc_feature: Encodes the peptide sequence at SEQ ID NO. 87590
  misc_feature (357)..(357): n is a, c, t, g, unknown, or other
  misc_feature (404)..(404): n is a, c, t, g, unknown, or other
  misc_feature (405)..(405): n is a, c, t, g, unknown, or other
  misc_feature (413)..(413): n is a, c, t, g, unknown, or other
  misc_feature (484)..(484): n is a, c, t, g, unknown, or other
  misc_feature (550)..(550): n is a, c, t, g, unknown, or other
  misc_feature (671)..(671): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (762)..(762): n is a, c, t, g, unknown, or other
  misc_feature (767)..(767): n is a, c, t, g, unknown, or other
  misc_feature (768)..(768): n is a, c, t, g, unknown, or other
  misc_feature (931)..(931): n is a, c, t, g, unknown, or other
  misc_feature (947)..(947): n is a, c, t, g, unknown, or other
  misc_feature (972)..(972): n is a, c, t, g, unknown, or other
acccgcggtggcggccgctctagaactagtggatcccccgggctgcaggaattcgtctcacccctagaaaaaatcactgcactggtggtgtccgtggtgctccacagagtgaagcgatagccaggagaggcgacgatgcgcaagtgggcgctctcctgcgcgctcgtccgcctctttctcctcaccacactccccgacccagctaagaagctacaagtgaatgccgaggagagcagcgatgacttggctaacccacccaaggtagaggagaagcttggtgctgtccctcatgggctgtccaccgagtctgaggttgcccagagggcaagccgagtctatctctaggaagactctcangagctccgccgagaagtttgagttctggggtggggcccccacactcnnggacatcntcatcaactcacttcccagtaacacggagatctttggagaggaaacttatttataaatagctatgaatgcnttagataataatagggttcatttctctttatggataatgatagtttatgggttaaatgggaaaatnggcagaatcgtaggagaattaaacgattaaatggtgggaccaatggggtaggaattagtcctcgttcaattttgggggattaggggggtaattcggggaatggggccgaaaggataagganccggaacatagagaaaactatatatggnnnatttgagggcttaaataaatttaagcagcctttcaacatttttgatggggaaaaatgaatncaagnnctcgtgagggtggagaactaatatccaatattggcaacaagacatgggggggttgcgcaaattcagaatgataggggaacccgggggcgggattaagcaaagatatataaggagcctacaaggagacatgcatagagggatcaaaacgttacgggttatatgnaatctcaaagatgganggaaatatatatttacaatatatgnggaaaagatatgagaaaa

SEQ ID NO: 87590 - protein, 69 aa, Zea mays
  misc_feature: Ceres CLONE 1574692
MRKWALSCALVRLFLLTTLPDPAKKLQVNAEESSDDLANPPKVEEKLGAVPHGLSTESEVAQRASRVYL

SEQ ID NO: 87591 - DNA, 942 bp, Zea mays
  misc_feature: Ceres CLONE 1574695
  misc_feature: Translation starting site: 219
  misc_feature: SWISSPROT Homolog: EC 1.14.99.30 Carotene 7,8-desaturase
  misc_feature: SWISSPROT Homolog: EC 1.4.3.2 L-amino-acid oxidase
  misc_feature (924)..(924): n is a, c, t, g, unknown, or other
agctccccgcggtggcggccgctctagaactagtggatcccccgggctgcaggaattcgtctcacccctagaaaaagcaactgggctcccccgcctccacgacactgccccccgcctcaagtccgccgcctccattcttcagctctcctatcctccgtctgcctgtacctattggctgaagaagagctgacccccactttatcaagagttgctcaacaatggacactggctgcctgtcatctatgaatattactggagctagccaggcaagatcttttgcggggcaacttcctcctcagagatgttttgcgagtagtcactatacaagctttgccgtgaaaaaacttgtctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggacataaacccatattgcttgaggcaagagatgttttggggtggaaaggtagctgcttggaaggatgaagatggagattggtacgagactgggcttcatatcttttttggagctttcccaacatacagaatctgtttggcgagcttaggattgaggatcgtttacagtggaaaaacactctatgatattcgccatgccaaacagccaggagaaatcagccggtttgatttccccagaactttgccagcacctataaatgggatatgggcccatatgagaaacaatgaaatgctacctggccccgagaaggtgagtttgcatcggacttctgccagcaatgggtggtggtcnacccttatgtgaagctca

SEQ ID NO: 87592 - DNA, 941 bp, Zea mays
  misc_feature: Ceres CLONE 1574697
  misc_feature: Encodes the peptide sequence at SEQ ID NO. 87593
ggagctccccgcggtggcggccgctctagaactagtggatcccccgggctgcaggaattcgtctcacccctagaaaaaaaggccccccgcattccgtcccgccgcggcgtcgctcccttgttctctcccgagccgtccgcgaaccaacccgtgctacctccgattcttcgcctcgtcgttctttctagaacctccgctccgcctaatcccgaacgagactagggaggttccagcgccgccggtgggggagatggcgctggagctgagcctggcctcggcttcgcccccgggcgggcggcggcttggcgcagccgccgcccctcgccccacccgggaaggagcagcaagtggccggcgtggggattctactgcagatctccatgctcgtgctctcgttcgtcctcggccacgtcctgcgccgccaccgcttctactacctccccgaggccagcgcctcgcttctaattggcttagttgttggtggcctcgctaatatttcaaatacagagaccaacacaaggacgtggttcaacttccatgaagagttcttcttcttgttcttattacctccgatgatattccagtcgggtttcagcttatctccgaaaccattctttgcaaactttggggctatcgtaacttttgcaattcttgggacattcattgcttctgttgtaacaggagttcttgtctatcttggtgggctgacatttctaatgtacaaacttccactggttgaatgccatatgtttggtgctcttatatctgcaactgatcctgtcacagagctatcaatatccaagtaaccgggttctgatcgtaaactgtatgcggtggtggttggaaatctgatttgaatgatgcgatggcgatttctcttgaaggaacatgtcatccgtctgaagccatgcaggatgcggggaaaacctttttatgatgat

SEQ ID NO: 87593 - protein, 141 aa, Zea mays
  misc_feature: Ceres CLONE 1574697
MLVLSFVLGHVLRRHRFYYLPEASASLLIGLVVGGLANISNTETNTRTWFNFHEEFFFLFLLPPMIFQSGFSLSPKPFFANFGAIVTFAILGTFIASVVTGVLVYLGGLTFLMYKLPLVECHMFGALISATDPVTELSISK

SEQ ID NO: 87594 - DNA, 1019 bp, Zea mays
  misc_feature: Ceres CLONE 1574698
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (259)..(259): n is a, c, t, g, unknown, or other
  misc_feature (285)..(285): n is a, c, t, g, unknown, or other
  misc_feature (296)..(296): n is a, c, t, g, unknown, or other
  misc_feature (718)..(718): n is a, c, t, g, unknown, or other
  misc_feature (954)..(954): n is a, c, t, g, unknown, or other
  misc_feature (955)..(955): n is a, c, t, g, unknown, or other
  misc_feature (973)..(973): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnccaaaagctggaagactccaccccggtggcggccgctctagaactagtggatcccccgggctgcaggaattcgtctcacccctagaaaaaagacgtttccacctccatcaccgctggtcggctatgtgcatcgcggcatgggcgtggcactgccacccgacgcaccgcctgcttctgctgttncatcgcgacgagtatcactccagccnttgtccattgnagtatgcccacagaatttgcaagggaagcggatcagtacaatggcttttaaactttatattagctgatgtggacctccggaccatggtttacattctctaaagaacccgaagggaatcccgtgatttcaaacgtttgccccgggggcctccaggggcttttccaagggctgcaattaaatcccccctttgccccaaagggaaacccctttttaggaaaggggtttttaaaaaaaaatttttgggcaaatcccccggggtgggcggaagaccccttttttaaaaaaacaaaggttgaaaaaaaattttttaaagggggaaccccccccccaccccccccccaaaaaaacttttttggggggggggtaaacacccccgggggaaaaaacccccttttgtgggggggggggaccaacaaacacanccccccccaaaattattttttttttccccccccccccaaaaaagaaaaacacgccccgccctcctttttgttttcacccccccccccccccgggggggggggggggcccccccccccccacaaaatttttatataagggggggggggggaggccagctttcctctttctataaaaagaaaatttttttttaaaaaaaaaaaaaaattttttgtggtgggggggaggaagaaataanntttctttttctccccccnggggggggtcggggggggggggggggggcagaaacaattatttttt

SEQ ID NO: 87595 - DNA, 905 bp, Zea mays
  misc_feature: Ceres CLONE 1574700
  misc_feature: Encodes the peptide sequence at SEQ ID NO. 87596
  misc_feature (505)..(505): n is a, c, t, g, unknown, or other
  misc_feature (574)..(574): n is a, c, t, g, unknown, or other
ctggagctcaccgcggtggcggccgctctagaactagtggatcccccgggctgcaggaattcgtctcacccctagaaaaaaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcaagcctgctcttccgtgtgctgaagctggcgctccccgccctccgcgacgtggagggcggccgggcactcgcacgcgcgctcgccgtcgccgcgaccctcgctgaccntcagatggatgctgaagtcatatcagccggcatactaagagaagcattagatgcaggagctgtaagaantgagggatgttaaaacccagattgggatcagcccagctcatttgctgcatgacagcttaaggattaggcatgctcctttcaaaccttgacttattggaaaaagaaggggcaaaccccttggaaaaggttattccttcaaccaggaaaacggggcagtcaatttggaactttgaaaagaaacttgtaaagaagaaaaacccctgaataccctccccaaaaattgcccgaaaaaaaaatttccccaaacctagaaaaaatttccccccctttccccattcttttggaggggggaaaatttttccccaaaaaaaaagaagatttttcttctttt

SEQ ID NO: 87596 - protein, 148 aa, Zea mays
  misc_feature: Ceres CLONE 1574700
  misc_feature (122)..(122): Xaa is any aa, unknown, or other
  misc_feature (145)..(145): Xaa is any aa, unknown, or other
MATATAAPVPAGGHPYRRARTRCGPPRLHRLRFPAAAAAASSSLPAPSSMLPPLPDGGGRLVAELVCAFNELTERMGEDLATSSSSSLLFRVLKLALPALRDVEGGRALARALAVAATLADXQMDAEVISAGILREALDAGAVRXEGC

SEQ ID NO: 87597 - DNA, 967 bp, Zea mays
  misc_feature: Ceres CLONE 1574702
  misc_feature: Encodes the peptide sequence at SEQ ID NO. 87598
ctccccgcggtggcggccgctctagaactagtggatcccccgggctgcaggaattcgtctcacccctagaaaaaactcagcagcagcacgcgctctgctccccacgccagctcgcccgagccccgaatcgagtcccctaccccatcgatccccgccgcccgcctttccccgccgcccgcctttcccctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgcagccgctggagtggcggtttgcgcaggtcttcggccacccccccgcgggagaagatgtgcaagatgtggacataatatctgcaattgagtttgacaaatctgggaatcatcttgctactggagatagaggtgggacgtggggttttgttcgaaagaacagacattgctgataatgcttgtcgaaggaaacttgagagggaagaatatcctgtttctagggatcccggaagtccgttacaagaaccgaattttcaaagccaggaacctggagtttgaccacccaaaaaagttggggaaatacgaaaaaaaaaattaaccaggttcccggggtgggccaaaacaaacaaaaatggcacccccttcccctgggccccaaagggaaaaacaattccattttttggaaagggtccaaaaaaaaaaggggaaaaccggtttcccgataaaaattttgaaccccccccaaatttaaaaaaagggtgtaaactccaagcggggggaacagattttgggaaaaccctttcccaaagggggggcgcccagtaaaaaggggtcccacaaaaatatgtctttctcccccagaaaaaccaactccttttttccttggggttaaaaaa

SEQ ID NO: 87598 - protein, 79 aa, Zea mays
  misc_feature: Ceres CLONE 1574702
MEREPKSPDDRPEPAAAAAQPQPQPLEWRFAQVFGHPPAGEDVQDVDIISAIEFDKSGNHLATGDRGGTWGFVRKNRHC

SEQ ID NO: 87599 - DNA, 938 bp, Zea mays
  misc_feature: Ceres CLONE 1574704
  misc_feature: Encodes the peptide sequence at SEQ ID NO. 87600
  misc_feature (547)..(547): n is a, c, t, g, unknown, or other
  misc_feature (548)..(548): n is a, c, t, g, unknown, or other
  misc_feature (558)..(558): n is a, c, t, g, unknown, or other
ctccccgcggtggcggccgctctagaactagtggatcccccgggctgcaggaattcgtctcacccctagaaaaacttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccactacttcgtggatctcctgcagcagaacggcgacaagaacctgtgctttcgctcactcatgccgcagacgtcctccggcgaacaatgcgtgatggggggaaggtgatctcgtggaccccacgtccagacagcttcccggacgccctggaagacgacagcaatgacgacggttgagaaatccnnagagctggancgcccgcattgtgcgcgacgccttgaaactaaagcgggctcaaggaagctgcacaaaacccccggcaagatcccatgcctatgcgtgggggggctggcccaaaggtttttccaagccaaggaattccaggatcaggcccgggcaaaaaaaatgttcccccccaagaaaggacccccaaaaaaagcgcaaaaaaaaatgggaggtcccccccccaggggtttttttcagggtcttttccaaaaaaggcaacccggttagaaggcccccccaaaaccccgggccccggggaaaaggaaaaggcctttttaaaacaaaaggcccggccccctcttcaattttggggaaaaaacccctcccgggcgcaaaaaatctccccctcg

SEQ ID NO: 87600 - protein, 52 aa, Zea mays
  misc_feature: Ceres CLONE 1574704
MMGGGLMMDQSVVFPGVHYFVDLLQQNGDKNLCFRSLMPQTSSGEQCVMGGR

SEQ ID NO: 87601 - DNA, 1046 bp, Zea mays
  misc_feature: Ceres CLONE 1574705
  misc_feature (959)..(959): n is a, c, t, g, unknown, or other
  misc_feature (969)..(969): n is a, c, t, g, unknown, or other
acccgcggtggcggccgctctagaactagtggatcccccgggctgcaggaattcgtctcacccctagaaaaatccctcctttgggcttgtctctgcctctctctctcctcccttctcccacccacccctttctcttgctgtgggtgtgctgtggagaggagaaaggaagtagagcaagaacaagaactaataacaccaacaagagctgctgccaactcctgcacagcctgggctctcatcactgattgcccacctattaccttcctcttttgcgatttagaatcacccatatatctacctgctctcggtcctctgtgaactctctcgtcttctaggtttcccaggcctcaacataggcctctggaccaaagcttgaaagcagctgcccccccccgcctctttttttaatatcttcatttgcgtggttcctcggatttttttggtttcttagggttttcttgatagcttccccccaacccttggcgaaaatcttgtgggcgaaagataactcgggttttccctcgttttcggggggtattgggtaccaaaaggatttccgtcccccccggtattttgttcgacaagtactgcggcaggtgccccatggaatcaattcctttcgccccctcaagccaccttcagattttctagagaaagggtaacattcctttttctttttgtgggggggtaagattaaggggggggaagtggctctgggcttcacaacgaagttttggttttgggaaattagtattattggtaaacgactgaggtgggatggccctctcttttatgggatttccaggggagacacacccactggagtttaggcgttattccaaaggttctgtctccacctgcgggaaaggccgctttacatgatagacgataacaaacaccagtcggatttatctcgttgtggtaagaatagttccagctccgagattttgtcaagggtngcgtgatggnccagtgggttctccgctattaaccaaatggcgtcccgaacatttggtagtgggaggagatgtaacacctcaaccctg

SEQ ID NO: 87602 - DNA, 957 bp, Zea mays
  misc_feature: Ceres CLONE 1574706
  misc_feature: Encodes the peptide sequence at SEQ ID NO. 87603
tggagctccccgcggtggcggccgctctagaactagtggatcccccgggctgcaggaattcgtctcacccctagaaaaaaccccaacaccccatctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacccgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgaagcaaagagcgcatgctggggccgcaggccatctttcttccagagggggactaccacgcccaacttccgccggcttgttcttccggggctttttcccccgaggccatccgcgggctccgtggcggccattcgaggccttcgcgctgcgcttccttgaattcctgggaaggcgccctccgtaaaacccttccaagaaaagaaacttgtccccgctaatggtggaatttctggccctcttccggcaagaaaaaatacgcggccttgagagaactaaaacctggctccctggccctggaaaaaggggaaaaatcctaggcccctaaaacctgcggggcccctttttcccaagaggcattaaagccccaaacgcccgtgggcgcccttgtgtcccacttttttagggcccgggg

SEQ ID NO: 87603 - protein, 172 aa, Zea mays
  misc_feature: Ceres CLONE 1574706
  misc_feature: SWISSPROT Homolog: EC 1.14.13.93 (+)-abscisic acid 8'-hydroxylase
MGAFLLFVCLLAPVVVLACAVRGRKRRASSAAAGGKALPLPPGSMGWPYVGETFQLYSSKNPNPFFARKQNRYGPIFKTHILGCPCVMVSSPEAARFVLVTQAHLFKPTFPAKQRAHAGAAGHLSSRGGLPRPTSAGLFFRGFFPRGHPRAPWRPFEAFALRFLEFLGRRPP

SEQ ID NO: 87604 - DNA, 854 bp, Zea mays
  misc_feature: Ceres CLONE 1574707
  misc_feature: Encodes the peptide sequence at SEQ ID NO. 87605
tggagctccccgcggtggcggccgctctagaactagtggatcccccgggctgcaggaattcgtctcacccctagaaaaaaacacttcgcactcttctccccctcttctcttctcgtagacggcagatctccaggggtgtcgccgtctccggccacggcggccggcgctcggagcatcggtggggttcggtgcggaggtgggcggccatgtacaagaaccagctgcaggagctggcgcagcggagctgcttcaacctgccgtcttacacgtgcctgcgggaggggcccgaccatgcgccgcggttcaaggcggcggtgaacttcaacgggcagcagttcgagagccccggcttcttcagcacgctccgccaggctgagcacgccgccgcggaggtcgcgctcgccgcgctcgcgcggggcgggccggtcctactcgctcgtcgccccgcatcctggatgaaacaggggtttattagaaccttctaccggaggtagcttcaagaagttggggcgcccatgcccttttaatcaaacaaagccaatctggcgttggccaccctgcccggtttttccattgccccgtttaagcctgctgggaatccctttttccggggggacaagtccaaaaaaaaagaaacaggccttaaaaaaaagccagctttcggcgtgctgggcccgcccctaaaacaatttggccccccgaggaaaagaaaatttcttcccttggagaccaaaaaaccttgtttaaacccggggccaaattcggggttttcccggagcccccccctcaaaaatatcccttaaaaagaaaaaaaagaggccataggcccaatttttcctcccttgtgtttcccc

SEQ ID NO: 87605 - protein, 95 aa, Zea mays
  misc_feature: Ceres CLONE 1574707
  misc_feature (2)..(68): Pfam Name: dsrm Pfam Description: Double-stranded RNA binding motif
  misc_feature: SWISSPROT Homolog: EC 3.1.26.3 Ribonuclease III
MYKNQLQELAQRSCFNLPSYTCLREGPDHAPRFKAAVNFNGQQFESPGFFSTLRQAEHAAAEVALAALARGGPVLLARRPASWMKQGFIRTFYRR

SEQ ID NO: 87606 - DNA, 953 bp, Zea mays
  misc_feature: Ceres CLONE 1574708
  misc_feature: SWISSPROT Homolog: EC 2.7.7.27 Glucose-1-phosphate adenylyltransferase
  misc_feature (844)..(844): n is a, c, t, g, unknown, or other
ctggagctccccgcggtggcggccgctctagaactagtggatcccccgggctgcaggaattcgtctcacccctagaaaaaaacccaactgggactgagctgttgtgattcacatgtctaactcccgaaaagaaggcagaaggtcctttttatagctttcctcagtctgatgtgtgcttccatccttcgctttcgaaatctcccttgtatttgtgtacaccattgcaccaccaccctttaatcctttattatccagtccgttattccgcgagtacgttgatgatccctccttacggcagtaaggattccgcaaaagtatggctcccttttcccttgattgatgcggggatttgtcaggaactaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactggtttcacagtggcataaaacagatatttgttatgactcagttcaactcagcttctctttaccgtcacattcatcgtacctatcttggntgggggggatccacttcactgatggatctgttgaagggctggctgcaacacaatgcctcgggaagctgctgtttggttccagggcacagcagaccccgttagaaattat

SEQ ID NO: 87607 - DNA, 924 bp, Zea mays
  misc_feature: Ceres CLONE 1574709
  misc_feature: Encodes the peptide sequence at SEQ ID NO. 87608
cataagctggagctccccgcggtggcggccgcttcagaactggtggatcccccgggctgtcttgcaattcgtctcacccctagaaaaaaagagcaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatcttccggcgctgccacttcagcatacctagattgaaggggctttggaacgaaaggtggaaagggggcaaggcacttggggacgacttctgccacaacccttccggaggggaatagcgaaccgaacaaatgggggattgttggaacaaaacccctacttttttggtttaggggaggaaccccaaaatgcctcaaaggaaaatgggtttgtggaccccctaaagggtttcccctagtcttggggggccaaaaattttggcccataggggaaacaacccaaggggagggctttaaacattaaaggggccccggggtccctccaaaaagggtggtatcaccttgtgtgaaaaaaaaaaacgggattaaaacaccatttggggaatctttgttgcccggggggaaaccacccttattacatagggggggaaatatctcaggggggcctttttagaaaaaaaaggagttggaaaaaataacaccagattatttccgcaaagagggggccttgttgttaccaacgag

SEQ ID NO: 87608 - protein, 119 aa, Zea mays
  misc_feature: Ceres CLONE 1574709
  misc_feature: SWISSPROT Homolog: EC 3.2.1.21 Beta-glucosidase
MAPLLLASRTACRPGLTSRHAHDNGRHGLSSSPPGSRSKRSRSLSLRPRAEKTTTGGGGHVVSEKLSPWQIPRREWFPPSFIFRRCHFSIPRLKGLWNERWKGGKALGDDFCHNPSGGE

SEQ ID NO: 87609 - DNA, 965 bp, Zea mays
  misc_feature: Ceres CLONE 1574710
  misc_feature: Encodes the peptide sequence at SEQ ID NO. 87610
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
ctggagctccccgcggtggcggccgctctagaactagtggatcccccgggctgcaggaattcgtctcacccctagaaaaagaccctctgtctccatccgctccggcgtgccaaccacgcaggctaacgtctgggctcccctccttatcgccgggctccgcatcgccaatagtctgatggcgccgcatttgcagggctgctactggatctcctcctggccgcggctcctgcagatgtccccttggccgccgcgctcctccgaatcgccgcggtggagcttcctgcgtctcgctacgcgcctactcccctgcacaggctctgtccgcgccgtctctagcgcgggcgcggtgggaaccgagctcctggagatggaggagcatgccgaggacgtggacgagagggagaggctcacgcggacacagatctcactggcgaacaagggtaacacaccatggaacaaaggcaggaagcatagcccagagacgctgcagcgaatccgtgagaggaccatgatcgctatgcaagaccccaaggttaagaaaaagttggcgaatctgggtcatgcacagagtgaggagacacgggtaaggatatcaatgggggtgacgcgaggttgatactttgcgtctacaataactaatggtccaagatggttgctttgtggaatggagggacatggtagctgatgcggctagaataggttttgctggtggagtttaccttgcatggaattcatataatatgctgagtgagcatatgctgcacgattggtttggagaatctcggaaaagcgatgcatgcccacgcctagatgctatagaccatctccaaaactcctgagcagaggatgaaaatgcacagcccttgctgccaagtggatgatcttgatatcgcggacgagattgtccgaagnnnnnnnnnnnnnnnnnnnnnnnnnnnnnnnnnnnnnnnnnnnnnnnnnnnnnt

SEQ ID NO: 87610 - protein, 82 aa, Zea mays
  misc_feature: Ceres CLONE 1574710
MEEHAEDVDERERLTRTQISLANKGNTPWNKGRKHSPETLQRIRERTMIAMQDPKVKKKLANLGHAQSEETRVRISMGVTRG

SEQ ID NO: 87611 - DNA, 1014 bp, Zea mays
  misc_feature: Ceres CLONE 1574712
  misc_feature: Encodes the peptide sequence at SEQ ID NO. 87612
  misc_feature (833)..(833): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
  misc_feature (983)..(983): n is a, c, t, g, unknown, or other
  misc_feature (984)..(984): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (988)..(988): n is a, c, t, g, unknown, or other
  misc_feature (989)..(989): n is a, c, t, g, unknown, or other
  misc_feature (990)..(990): n is a, c, t, g, unknown, or other
  misc_feature (991)..(991): n is a, c, t, g, unknown, or other
  misc_feature (992)..(992): n is a, c, t, g, unknown, or other
  misc_feature (993)..(993): n is a, c, t, g, unknown, or other
  misc_feature (994)..(994): n is a, c, t, g, unknown, or other
  misc_feature (995)..(995): n is a, c, t, g, unknown, or other
  misc_feature (996)..(996): n is a, c, t, g, unknown, or other
  misc_feature (997)..(997): n is a, c, t, g, unknown, or other
  misc_feature (998)..(998): n is a, c, t, g, unknown, or other
  misc_feature (999)..(999): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1006)..(1006): n is a, c, t, g, unknown, or other
  misc_feature (1007)..(1007): n is a, c, t, g, unknown, or other
  misc_feature (1008)..(1008): n is a, c, t, g, unknown, or other
  misc_feature (1009)..(1009): n is a, c, t, g, unknown, or other
  misc_feature (1010)..(1010): n is a, c, t, g, unknown, or other
  misc_feature (1011)..(1011): n is a, c, t, g, unknown, or other
  misc_feature (1012)..(1012): n is a, c, t, g, unknown, or other
  misc_feature (1013)..(1013): n is a, c, t, g, unknown, or other
atagctggagctcaccgcggtggcggccgctctagaactagtggatcccccgggctgcaggaattcgtctcacccctagaaaaagctactcaatttgatcaaccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggccgcgaaggaagtacaacttcagggtaaacgctgcaaaggagctgcatttcaacaaggatggctcggctatcaggaaaatgcaaaatggggtcaacaagcttgcagatctcgtcggggttactcttggaccaaaggggcgaaatgtagtcctcgaaagcaagtatggctcacctaaaattgtcaatgatggtgtcactgtggcaaaggaggttgaacttgaggaccctgttgaaaatattggtgctaaattggtccgccaagctgctgctaaaacaaatgacttggctggtgatgggacaaccacttcggttgtccttgctcaagggatgattactgagggtgtaaaggttgtagctgctggtgctaatccagtgcagatcacccgtggtattgagaaaacagccaaagcactagtcagtgaactccaaagatgtccaaggaggttgaggacagtgagcttgctgatgttgctgcagttagtgcgggaaataactatgaaattgggaatatgatagctgagctatgaaaaggtgggcngcaggagtgccactgagaagagatgcgaaacctctagagatcggtatccctgagagagacatacactctgaataacactctcgagtagactatgaatcagtgctgtgagcagtnnnnnnnnnnnnnnnnnnnnnnnnnnnnnnnnnnnnnnnnnnnnnnnnnnnnnnnnnnnnnnnnnnnt

SEQ ID NO: 87612 - protein, 214 aa, Zea mays
  misc_feature: Ceres CLONE 1574712
MASAFGTASTCGIKHAPAGVALAAPMKHLSLVSPSLVSLPRKMRPRRKYNFRVNAAKELHFNKDGSAIRKMQNGVNKLADLVGVTLGPKGRNVVLESKYGSPKIVNDGVTVAKEVELEDPVENIGAKLVRQAAAKTNDLAGDGTTTSVVLAQGMITEGVKVVAAGANPVQITRGIEKTAKALVSELQRCPRRLRTVSLLMLLQLVREITMKLGI

SEQ ID NO: 87613 - DNA, 888 bp, Zea mays
  misc_feature: Ceres CLONE 1574713
  misc_feature: Encodes the peptide sequence at SEQ ID NO. 87614
ctccccgcggtggcggccgctctagaactagtggatcccccgggctgcaggaattcgtctcacccctagaaaaaaactccacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcagatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagattcagcaaactgcaaaagttgaagctgaagaatgtgatgcctacgagggaggcaatgagcctgtaactatgatagaagaatcttcccctgaaattgaggccaaatggggaggatggaaaaagcgccgacctccactggagaatgggaggggcttcgggttttggaagattagcccttggacaatagctcttgaaattctagcggaaaaagacctttttttttaaaaattttttccaaagggaaagaaaaaaacccctttgaggggggggccctctttaaaaaaaacgcttccaagaaaaaaacccctttgggggctctccaattttttttagggggggggtggaaaaaaaaaccccgacggggtgggggagaaatttaggaggcccccccaaaaa

SEQ ID NO: 87614 - protein, 84 aa, Zea mays
  misc_feature: Ceres CLONE 1574713
MDPDFSPASGGPSFEFAFNSVNFSDRVLQIEIVAGDDALGAKGATGEGCSSLADWACHRKRRREELRRDKESRKYMPDSANCKS

SEQ ID NO: 87615 - DNA, 921 bp, Zea mays
  misc_feature: Ceres CLONE 1574727
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaagttatcgcaaggggcatttagctgcctgcctccgatgccggacttgctacctaatcgccgcgcttgttttcactcctcccgatggtcgccttcacgtcgccgacgcagtccgagccgtcgccgcacatctgggtcgcccggcctcgtctgccgcctccgcggccaaacgctggacggggcggggatgagtgccgccagaccgtctctcttgatggggaagtacgatctggggctgcctcctgtggcactgcaccttctctaaatgtaacacgcacgatcacatcgacacggtggacaacgttgccatcaaagttgctcgactaggagaaggccatgtatagagcgtgtgctcatcccgatacatcaagcgctatatcgctgtgctacatctcgtgcgccacccgaacatcgtgcaccatgttcgatgttatggccacatcagactaaaatctgcttcctcatggatctcgtccgccgaagctatctcttctcccgcgtcgtccgaagggcgactcatggatgacaccgcgctgcggctacttccagaagctcatctccgccgtgtggttctgccacgcccgcggcgtcttccctctgacctgaatgccgcagatctactcgtctagagcagggtaactcacgtatcagatatgagctctgcgccgtcaccgacagatgcgtgcccatgactggtcatacttctgaggattgcttgctagttgccccgaatgatcggcggctctggttgactgtgccatgcaacatgtggccggcgcgtcatctcttgtttcatgacggaatctcatttcaggaaaagctcatgtctgtcaaaaatttctgggcagtcc

SEQ ID NO: 87616 - DNA, 860 bp, Zea mays
  misc_feature: Ceres CLONE 1574728
  misc_feature: Encodes the peptide sequence at SEQ ID NO. 87617
ctggagctccccgcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtggtattgagaaaacagctaaagcactagttgaagaactacggaagttgtctaaggaggttgaagatagtgagcttgcagatgttgctgcagttagtgctggcaaacactatgaaattggtacatgatagcagaggccatgagcaaggtcggtcggaagggcgttgtcaccttgaaagagggaagagt

SEQ ID NO: 87617 - protein, 193 aa, Zea mays
  misc_feature: Ceres CLONE 1574728
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGKHYEIGT

SEQ ID NO: 87618 - DNA, 973 bp, Zea mays
  misc_feature: Ceres CLONE 1574729
  misc_feature: Encodes the peptide sequence at SEQ ID NO. 87619
  misc_feature (947)..(947): n is a, c, t, g, unknown, or other
aagctggagctccccgcggtggcggccgctctagaactagtggatcccccgggctgcaggaattcgtctcacccctagaaaaagctcgctctagtcctccgactccaagacctcgagtcctcttcctctcccctcacctccctcaacctgcagcttcgacgtcacctcctctcttcccgtctgcgctctctcccctggtgcgccgggctacaggtttcctccagggctgcaggaagcagcttctgttgcagcttgaatcgagaagtggcgtggtaacatcaccagggagaagttggattgttccgccagagtgctcgatgacagatcatttcgctctaggtctaggtgctcttcttcttttgctgctaagtagcagctgtttcagttccgaccttgatgtccaacgcctgagagacgttaagcaatcagtgaccgatcctactggcatactaaaatcctcatgggttttcgataatacctctgtgggtttcatatgcaaatttcctggtgtggaatgctggcaccctgatgagaaccgagttctcgcattgcgtctcagcaacttggccttcagggcccatccccaaaggcctcaagacctgtaccagtatgactcccctggaaccggccaagtaaaaccttaaagggggcattccttttaaaaatccaaaaaaaaatgcccttcttaaaatcccgggacccctcctaaaaaggtttttctggggaaaacccggggctccctttataaatccggccccaaaaaccccttaatttttagaaaaccatgtgaggggggaatttcccggggattttcccccccctttctcgggtaaggatattaatgttggaaaaacacggtgggggggaaaatccccaccctctaaaaaaaccccgggaaataattccgggaataaaaaaaagttggggcccccctttgggagaaaccncttctccaaaaaaaaaaaacctcctt

SEQ ID NO: 87619 - protein, 108 aa, Zea mays
  misc_feature: Ceres CLONE 1574729
MTDHFALGLGALLLLLLSSSCFSSDLDVQRLRDVKQSVTDPTGILKSSWVFDNTSVGFICKFPGVECWHPDENRVLALRLSNLAFRAHPQRPQDLYQYDSPGTGQVKP

SEQ ID NO: 87620 - DNA, 1011 bp, Zea mays
  misc_feature: Ceres CLONE 1574730
  misc_feature: Encodes the peptide sequence at SEQ ID NO. 87621
  misc_feature (1011)..(1011): n is a, c, t, g, unknown, or other
aaagctggagctccccgcggtggcggccgctctagaactagtggatcccccgggctgcaggaattcttctcacccctagaaaaaccactctcaaaagtctggggtgacatagatttctacctgttagcaccagacaccttgttttctcgaggctgcaagtatgaaaagttgcacgatgataaggctgtgtggaaatatcgtaaggaacctcatcaatcacaaatgtggctggcttttcaaagaacctgttgatccacatctatatgggattccagactactttgatgttatccgcagtacaatggatttgggcactattaagaataaactgactaaaaagaaatatgtaagcattgaggagtttgcaacagatgtgaggctaacattttcaaatgctatgaagtataatcctcccggccaatgatgtgcattattttcgctaaacaaattgaatgaaaagatttgatttaataatgggaaatcgccagaaaaggaaaatttcagagggccgaaatccgttgggtccatgaacctgccaatattattggaaaggcccttaaaaaattcggagcctaataaatggaattcccaaggcctaaaaagtttcgccaaaaaggggccaggtttttcctttctccccaaaacccccataaaaacctttggggtttggcctaaaaaggaacccaagataactttggcccccaaattttccaattgcgcacaaaaaaaaaaaactccgccctaaaacccatatttccctcccaacaagttaaaaaaatacaaaattttttccacgtgggcccagactccttggggcgtttacccttcttcccaaaaaaaataaatcctgttatgaaacccagcggggagtaaaaaaaaaaaggagggccctttaaccccctttgtgtctctcatatggggtacaacaagaaagcgcccctccaaaatttgacaccctccccccacaccggaagaggagggcttaaatatttggggcggccacataaattn

SEQ ID NO: 87621 - protein, 87 aa, Zea mays
  misc_feature: Ceres CLONE 1574730
  misc_feature (6)..(88): Pfam Name: Bromodomain Pfam Description: Bromodomain
  misc_feature: SWISSPROT Homolog: EC 2.3.1.48 Histone acetyltransferase
MKSCTMIRLCGNIVRNLINHKCGWLFKEPVDPHLYGIPDYFDVIRSTMDLGTIKNKLTKKKYVSIEEFATDVRLTFSNAMKYNPPGQ

SEQ ID NO: 87622 - DNA, 996 bp, Zea mays
  misc_feature: Ceres CLONE 1574733
  misc_feature: Encodes the peptide sequence at SEQ ID NO. 87623
ccgcggtggcggccgctctagaactagtggatcccccgggctgcaggaattcgtctcacccctagaaaaatacattcgggtggacttctttgttgggctcggttctgctagtctaattacaggttgtcagaaacaagcagcactcttctgggcagaacagtagcaattgaatcccggaaacaaagtcaggtgccagcagaggggaccattttcaccaataatcaggctgtggagaatacccggttgtctgaaacatcagtttccccaaggaaagaatttcgccctcaaaatttggatcttgcaaatgatcgaactacatactgccgtggtcggagatcaaccgaaatcgtgttcagtacacaagtgcccacttctcctcctagttcaagaccacatcactatcaaaattcgcctgtgccatcaagaacatttgggcaatgccctgcatctcctacttcatggcaagatgattcgcgaaactgaagctcaaccccaaccacttcctctttcctccagggtcccccatgcttggctttcctctttctcttacaggggaagaaaggggaagtttgcctagggaatgggaaactttggggcaaagtatacattggggatttcaacacgtgaagggggagccaatatgggggacaatttaaaaaagggttaaaggggcttcttccaagataattccctaacccaaaagggagtcccccccgggcgggcttataacgggaaaaccctgggccggtgaataacaccttttcaaaaccaaaaaaattggttcagataacattggggagggatttgggtaaaatccgggaataaaagagggtcctctccgaggaaacgataaaaattctttttaaaaaccgcaaaaaggccggggttttacacccttaaaaaaaaaatttgccaaagggcgcctattattaggggggttttttcgccaaaaaggaggcaaaaatacaacccccgtctctaccaaagaatgcgtcg

SEQ ID NO: 87623 - protein, 53 aa, Zea mays
  misc_feature: Ceres CLONE 1574733
RGGGRSRTSGSPGLQEFVSPLEKYIRVDFFVGLGSASLITGCQKQAALFWAEQ

SEQ ID NO: 87624 - DNA, 932 bp, Zea mays
  misc_feature: Ceres CLONE 1574736
  misc_feature: Encodes the peptide sequence at SEQ ID NO. 87625
ctggagctccccgcggtggcggccgctctagaactagtggatcccccgggctgcaggaattcgtctcacccctagaaaaagttttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcggggtgggcgtggcgccccgagtggggcaggggtcgtcgtcggcgaccacaatgctcagcaggggggggcagttcccctcgccgcccgcggttggcggggtggtcccctcgcaacgaggcgcccgccgtcgtaccgaaaaactggtgttggctcctgcggcgccccaaggacagcaagctggcggtgacccacccgtgacttgatgccacctcttgcggctctgtcaggaaaaaggacggtggccccgtcttggatcccccttgatgaaccgcccctgccgaaccttaagtaccaagcctggcggaaaaacccacccaatggtcccccccagtaccgcagaacccattttcttgaggaggccccccccgagggtgtggaaaaattctcttgggaaacaaaaattc

SEQ ID NO: 87625 - protein, 108 aa, Zea mays
  misc_feature: Ceres CLONE 1574736
MSALLDLLMGIFRQQTLGGAALELAALAAPLWLAALVGLLIGVGVAPRVGQGSSSATTMLSRGGQFPSPPAVGGVVPSQRGARRRTEKLVLAPAAPQGQQAGGDPPVT

SEQ ID NO: 87626 - DNA, 990 bp, Zea mays
  misc_feature: Ceres CLONE 1574738
  misc_feature: Encodes the peptide sequence at SEQ ID NO. 87627
  misc_feature (526)..(526): n is a, c, t, g, unknown, or other
aaagctggagctccccgcggtggcggccgctctagaactagtggatcccccgggctgcaggaattcgtctcacccctagaaaaaaacacacttacatcctccacaacgatcaccccaatccattctctcctcacacgggcgcgacccaaaaccccattcatcccctcctccggtctcgactgccatggccgccgggcgggccttccttggcgcgccgtgctcctccctcgccgccggcgcccgttgccttgccttcgcttcccctttgccccggaacctcacccccgcgctccgctgcggcgttcgcggtcgctgcatcgcctccgcctcctcgtcccctgactcgccccccttgccggagccctacgtgctcaccactcctctctactacgtcaacgctccgccgcatatgggaagcgcctacaccaccatcgcagcggacgccatcgcccgcttccagaaggtgctagagaagaaatgtatattttataccgaaacagatgaacacggtgaagaaatatctgcntccgcagaagcccagtggtagaaacccaaaaggagcattgtgatgcaattttcaagtccatttagaacgctcctgggccgacttaaacttaaaatttgggcaagtttttttccccaaacggattgtaaacctgaaggctgttgggaaacaaattcatttcccaaagggtaaacaatgggaaaatttttgagactgaatttgaaaggacttttttggggaccccgggaaaattcccgggtaaaaaaaacctttgggaaaaaaatttggcccccggcactaaaaaccttgtgtgaaaaaaaaaaaaaaaaaatttttttgcccgggggaagccccaaaatttgggagaacccctcgaaaaaaaccccttttttgggggcacattctctttaagaagagcggggggggaaaaaaagaaaaagaagatttttttttttccccccccaaaaaaagggcgccccgcaaaa

SEQ ID NO: 87627 - protein, 120 aa, Zea mays
  misc_feature: Ceres CLONE 1574738
  misc_feature: SWISSPROT Homolog: EC 6.1.1.10 Methionine--tRNA ligase
MAAGRAFLGAPCSSLAAGARCLAFASPLPRNLTPALRCGVRGRCIASASSSPDSPPLPEPYVLTTPLYYVNAPPHMGSAYTTIAADAIARFQKVLEKKCIFYTETDEHGEEISASAEAQW

SEQ ID NO: 87628 - DNA, 845 bp, Zea mays
  misc_feature: Ceres CLONE 1574739
  misc_feature: Encodes the peptide sequence at SEQ ID NO. 87629
ctggagctccccgcggtggcggccgctctagaactagtggatcccccgggctgcaggaattcgtctcacccctagaaaaatgcactgtctctcccatgctttctcttggtaggtgttctctgcctgcctcctccaaccccggcccctcactagaattcttgtcgcaagcacacaccatgatctgttacatgctgtggttagcggcatgctgcctcctcctcttgtacagcgttcgattcaggtccggctggagccatggcaacggccccaggagctaccccgtgattgggtgcctggtcgacttctacaagaaccggtggcggctgctggactggtacactgagctgctggcggcgtcgccgacgcagacgatcgtggtggaccggctgggcgcccggcgcaccgtggtgaccgcgaaccccgtgaacgttgagcatattctcaagagcaacttcggcaactaccccaaggggaagcccttcaccgacatcctcggcgacctgctgggcaccggcatcttcaacgtcgacggcgagctgtggtacgcgcagcggaagctggtgagccacgagttctcggcgcgcgcgctccgggagctggagttcgccgtgctcgaggacgaggcgcgggagcgccttgtgcccgccctgggcctggcggctgcgcgcggcgacgtcgtggacatgcaggacctgctccggcgcttctcgttcagagtcatctgccgcgtgtcgctgggcgttgaccccgggtgcctggaccctgcattgccggcgccgaagctgggcgcggcgttcgacgcggcggcggggatcatcgccaggcgcggcgcggcgcccgtggca

SEQ ID NO: 87629 - protein, 223 aa, Zea mays
  misc_feature: Ceres CLONE 1574739
  misc_feature: SWISSPROT Homolog: EC 1.14.14.1 Unspecific monooxygenase
MICYMLWLAACCLLLLYSVRFRSGWSHGNGPRSYPVIGCLVDFYKNRWRLLDWYTELLAASPTQTIVVDRLGARRTVVTANPVNVEHILKSNFGNYPKGKPFTDILGDLLGTGIFNVDGELWYAQRKLVSHEFSARALRELEFAVLEDEARERLVPALGLAAARGDVVDMQDLLRRFSFRVICRVSLGVDPGCLDPALPAPKLGAAFDAAAGIIARRGAAPVA

SEQ ID NO: 87630 - DNA, 953 bp, Zea mays
  misc_feature: Ceres CLONE 1574744
  misc_feature: Encodes the peptide sequence at SEQ ID NO. 87631
ctggagctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagactgcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactcttgctggtactcctgcagctcctgccacggtgaaccattcggcaagccgcgctttcctgattctgcctttccttgctgtccgggcctggtgtatgtcgtcaaaacagcggaagaacccagggccgcctcccttggaaaaaggtgtttgaatctgaagaaattgctgaaaaaacgggggcttggggtcccccccccatctctttgccctgtgggctggggaacttttataatttcttgccttgggaaaaaggggggaaatgcactcggaaaagggctcccgccgttgggaataaaattttattgccaa

SEQ ID NO: 87631 - protein, 200 aa, Zea mays
  misc_feature: Ceres CLONE 1574744
  misc_feature (28)..(199): Pfam Name: SBP56 Pfam Description: 56kDa selenium binding protein (SBP56)
MAGAAAVETAAAAAAAAAAANGKACCHAAKGPGYATPLEAMEKGPREKLVYVTCVYNGTGINKPDYLATVDLDPSSPTYSQVIHRLPVTHIGDELHHSCWYSCSSCHGEPFGKPRFPDSAFPCCPGLVYVVKTAEEPRAASLGKRCLNLKKLLKKRGLGVPPPSLCPVGWGTFIISCLGKKGGNALGKGLPPLGIKFYCQ

SEQ ID NO: 87632 - DNA, 819 bp, Zea mays
  misc_feature: Ceres CLONE 1574750
  misc_feature: Encodes the peptide sequence at SEQ ID NO. 87633
  misc_feature (644)..(644): n is a, c, t, g, unknown, or other
ggagctccccgcggtggcggccgctctagaactagtggatcccccgggctgcaggaattcgtctcacccctagaaaaacgctcttgtcttcagaagtttcagatcctcgcatcgtccgcaccttatcctctcgactttacagtacctgctctcagctcctccctatctcaatggcatccgcgaatgccatctccaccgcctcccccttccggcccctctctcagggcagggcgacgaggtcacagcggttcgtggtgcgtgcgaacgccaaagacattgcctttgaccagaaatccagggcagcgctgcaggccggcgtcgagaagctcgcaaacgccgtcggtgtcaccctcgggccacgagggaggaatgtggtgctcgatgagtacggcaaccccaaagttgtgaatgatggagtcactattgcccgtgctattgagctgtatgatccaatggaaaatgctggtgcagcattgattcgtgaggttgctagcaagaccaatgattcagctggtgatgggactacaactgcatgcgtccttgctcgtgaaatcatcaagctaggccttctgagtgtaacatctggtgcaaatcctgtatcactaaagaaaggaatagacaaaactgtgcagggcctaattcangagcttgagaataagtctagaccaatcaaggggtggtggtgatatcaaagctgttgcatctatctctgctgggcatgatgaaattatcggaatcatgattgctgaagcattgacaaagtgggccctgatggtgtctatcaatgaaaatctctcgtcttttgagacactggtgaag

SEQ ID NO: 87633 - protein, 171 aa, Zea mays
  misc_feature: Ceres CLONE 1574750
  misc_feature (158)..(158): Xaa is any aa, unknown, or other
MASANAISTASPFRPLSQGRATRSQRFVVRANAKDIAFDQKSRAALQAGVEKLANAVGVTLGPRGRNVVLDEYGNPKVVNDGVTIARAIELYDPMENAGAALIREVASKTNDSAGDGTTTACVLAREIIKLGLLSVTSGANPVSLKKGIDKTVQGLIXELENKSRPIKGWW

SEQ ID NO: 87634 - DNA, 951 bp, Zea mays
  misc_feature: Ceres CLONE 1574751
  misc_feature: Encodes the peptide sequence at SEQ ID NO. 87635
ctacccgcggtggcggccgctctagaatagtggatcccccgggctgcaggaattcgtctcacccctagaaaaacctcctccttgccgccgtgcggttgagcgccgacgagcaagcccgacgccaccctatggctatggaggtccgccgcagggttccgccaccgcacgggagcgccccacggcgccagcaggcgaccggcggcgaggggcagcgggtgcgtgtgcaggcgggggacgcgctgccgctgccgatccggctcacgaacctcatcttctcggcgctgttcgccgcgtcgctggtgtacctgatgcggcggtggcgggagaagatcctctcctccacgccgctccacgtggtctccctcgccgagatcttcgccatctgctgccccgcggcgtcgctcatctacctcctcagcttcttcgggatcgccttcgtgcagtccgtcgtctcctacagcgacgacgatgatgacttcatcatctactcccgccacggacaggcgcgggcgccgccaccgcccgcgacggcggccccgtgtgcgctgctggggagccccgccgccgcgccggataaaatgccggaggaggacgaggagatcgtggcctctgtcgtggcaaggtagatcacgtcctacgtgccggaaactaggctggggaaatgccgccgggccccccgggatcaagcggggagggcccttccccggatacccgtgtagggaatatgaccggccccccccccaatggggtcaaaaaaaagtccattcccttgcaattgttgctaacttccgcgggggggtttctgaactattcccgggggggtgctgggccccttccttttttattggaccccggttctttctttccaatgtggccccaccgagggggggcatctgtagccgccaaccaccccgagaaaaaaggatatattcaaaaactccggtgggcccc

SEQ ID NO: 87635 - protein, 163 aa, Zea mays
  misc_feature: Ceres CLONE 1574751
  misc_feature: SWISSPROT Homolog: EC 1.1.1.34 Hydroxymethylglutaryl-CoA reductase (NADPH)
MEVRRRVPPPHGSAPRRQQATGGEGQRVRVQAGDALPLPIRLTNLIFSALFAASLVYLMRRWREKILSSTPLHVVSLAEIFAICCPAASLIYLLSFFGIAFVQSVVSYSDDDDDFIIYSRHGQARAPPPPATAAPCALLGSPAAAPDKMPEEDEEIVASVVAR

SEQ ID NO: 87636 - DNA, 994 bp, Zea mays
  misc_feature: Ceres CLONE 1574753
  misc_feature: Encodes the peptide sequence at SEQ ID NO. 87637
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (473)..(473): n is a, c, t, g, unknown, or other
  misc_feature (476)..(476): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggaactccccgcggtggcggccgctctagaactagtggatcccccgggctgcaggaattcgtctcaccccctagaaaaaaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatcatggtgacatagatggggcaagcctagttacaaactcctatgtcatagaaagatgatggattttcaagcaaggccanccnacagtggcccatcaaaagaactgttcgaaccatgaatgtggaccttgaagagaataactgaccccgccttacgcccagaaagatgaagaggaaatggtgttcaaaaccgggaatccggcttgggcgcttctcgaaaagaagggaagccaggcccccctttgaccccatcttttaaatcaccagggtttcccaaggttaaacagtcctttaaaaaaaaccccctttttttctttaaaaaacaacccggggcgggaaaattacccccccaaaagataccaagggggggccctttccccttggaccaaaaaaaaaacctttcccaccttttttaggttggggaaccccttttaggaaggaaaaaggtgccccctccccccctttggaaaggcggccacaccaaaccccctttttccctccctcctttttttgggttgtttcgaaaggaaaccacttaaaaagggcggcccccctttttttccgcgaaataaaaaaatttttttcccggggggcccttcggg

SEQ ID NO: 87637 - protein, 46 aa, Zea mays
  misc_feature: Ceres CLONE 1574753
MAGGGAGDDDVVVVSCGGRGGGDPGAYAAVLKRKLDLYCAAVAKSW

SEQ ID NO: 87638 - DNA, 924 bp, Zea mays
  misc_feature: Ceres CLONE 1574754
  misc_feature: Translation starting site: 152
  misc_feature: SWISSPROT Homolog: EC 1.4.1.2 Glutamate dehydrogenase
  misc_feature (766)..(766): n is a, c, t, g, unknown, or other
ctggagctcaccgcggtggcggccgctctagaactagtggatcccccgggctgcaggaattcgtctcacccctagaaaaaagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaagggatgctggggtgattgctggccttaatgtgctgcgtatcatcaacgagccaacagctgcagctatcgcctatggtcttgacaagaaggctaccagtgtcgggtgagaagaatgtcctcatctttngatcttggaggtggtacctttgatgtctccctcctcacccattgaggagggatcttttgagtcagggcacagctggtgacacccatccttggtgggtgagactttgacaacaggatgttcaaccaccttcgtcccaggagtttcagagaagaacaaga

SEQ ID NO: 87639 - DNA, 869 bp, Zea mays
  misc_feature: Ceres CLONE 1574755
  misc_feature: Encodes the peptide sequence at SEQ ID NO. 87640
tggagctccccgcggtggcggccgctctagaactagtggatcccccgggctgcaggaattcgtctcacccctagaaaaaagaactcacccctgcttcgtctggcggcgccgtttcccgcacgcgatgccgtcgacggcggaggatttcccggcgataaggaagctggggaagctcttccggcttaccgaagtgtacctctgggacgattcgtatggcgctggacctcacgatggacagaagaacgggcgctcggcggaggctgctctcgtggactctcatacagataaaacatgcaatgaagcatccaatagcactgacaaaggccatttctttgttgaagatttggaattggtcaatctcatgggttctttggggcttcctgtttcattcagcacaagtaaagtgaacaagaacacatgcaacaagggaaagaaaaaaggaagacaagcaccgctcaaagcagcaaacactcaaatcaatgatgctgtgaggatatgtatcaatactgaagatagagaaaattctgttgaatcattggatgctatggagcatacgcactcatgcaatttatttgtgacaccactgggtcaaaatgaacccctcccgtgatgacactgacaagaggcttaaggaagacagctcttgtggtgaaggaacaagacaatcctgggctgtagcacccatctactcttgctgggaaagcccctgggctgggatgctaaaaatcctcccccctgaacctggggctttttgaacttttcggataaacttggcccaactccggcaaaagaaaaaaaacctcattccaaaaaaaatcaactcttttaaaaagggggtttgccaaaattcccaaaaaaaagtttcaagt

SEQ ID NO: 87640 - protein, 161 aa, Zea mays
  misc_feature: Ceres CLONE 1574755
MPSTAEDFPAIRKLGKLFRLTEVYLWDDSYGAGPHDGQKNGRSAEAALVDSHTDKTCNEASNSTDKGHFFVEDLELVNLMGSLGLPVSFSTSKVNKNTCNKGKKKGRQAPLKAANTQINDAVRICINTEDRENSVESLDAMEHTHSCNLFVTPLGQNEPLP

SEQ ID NO: 87641 - DNA, 880 bp, Zea mays
  misc_feature: Ceres CLONE 1574756
  misc_feature: Encodes the peptide sequence at SEQ ID NO. 87642
  misc_feature (400)..(400): n is a, c, t, g, unknown, or other
aaagctggagctccccgcggtggcggccgctctagaactagtggatcccccgggctgcaggaattcgtctcacccctagaaaaattttctgcattcgacgccgccgcaggcccgcagccagctcgagcccaaaggagagaacccaggttggcggcggcgctccgcggcgatggactccccctacgctctccacctcgccatcgccgcgctcgtcggcgcctccttcgccgccgcctccgcctactacatgcatcgcaagaccctcgaccagcttctccgtttcgcccgcgaccagcagcgccgccgcaaccgcctcctccccgaaggcgacgaactggaggacggcgaagaggaccctccgccgcactgggatcatgatcgccgcaccctgcccatcccncccggcctcccgccgctccacaccggccgagagggtaggccagttgtttctccaggttcgactaaaagagttggacctattgttagaccgactacacccaaatcctctgtccccactatcagtgcatttgatagaattgaagattcagatgacgaggaggatcttgtcccagatgccaagaatgatactgcttacttgaccccaaatggtgctattggatcagatctcacagataaagcgagccagaacggggaattaacatcagcaccatcaacgcagatgattagatcccatagtgcaactggcagcctgcatgtaccccagctttaccccaaaagcagctgatatacttccaaagggagcctgaacatgaaaactttcagtaaaatcaacatcccagctggttgagacttccttcttcctgagtgaaattggaggcataccaaagtttcctcaaaaaatgccttggaggctggcgtt

SEQ ID NO: 87642 - protein, 191 aa, Zea mays
  misc_feature: Ceres CLONE 1574756
  misc_feature: SWISSPROT Homolog: EC 3.5.4.6 AMP deaminase
MDSPYALHLAIAALVGASFAAASAYYMHRKTLDQLLRFARDQQRRRNRLLPEGDELEDGEEDPPPHWDHDRRTLPIPPGLPPLHTGREGRPVVSPGSTKRVGPIVRPTTPKSSVPTISAFDRIEDSDDEEDLVPDAKNDTAYLTPNGAIGSDLTDKASQNGELTSAPSTQMIRSHSATGSLHVPQLYPKSS

SEQ ID NO: 87643 - DNA, 970 bp, Zea mays
  misc_feature: Ceres CLONE 1574757
  misc_feature: Encodes the peptide sequence at SEQ ID NO. 87644
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgtagacgtggtactcagctctcatcagggcgcggccgacgacggggagctcgccgcgcggtggcgggaggtcaccgcagcacaactggggaggtctgctggaccccatcgacggcttgctcctcagggacctaatcgctacgggaagttcgcccagcccacttacgaaaggtttgaaataagaccgttttcccccctatgggggaaggtgaaattccccggggaaaaaactttttccccaaaatcgggccctggggggattgggttaaaagggaacccgttttccttttcgccccgggaaagaacttaagttcccaattttgggttttaaaaaggggcccccacccaaaaggggggggggggccggggctttcttgggggtatgtgggggcggcccccaaaaaaaaaagaggggctcccccccggaaaaacccctggggtggggggcgccacccccccccctcggggggggggggaattataaaaaaaaacaccccccccgggaggaggcgcccccccgcccccccccccgtgttgtagt

SEQ ID NO: 87644 - protein, 161 aa, Zea mays
  misc_feature: Ceres CLONE 1574757
MAATVSSCLSLVPTVHHRAGGFPSSVALTNTLQRRRRSRRYLVVASATRAEQEAAPVTIVDVVLSSHQGAADDGELAARWREVTAAQLGRSAGPHRRLAPQGPNRYGKFAQPTYERFEIRPFSPLWGKVKFPGEKTFSPKSGPGGIGLKGNPFSFSPRERT

SEQ ID NO: 87645 - DNA, 856 bp, Zea mays
  misc_feature: Ceres CLONE 1574758
  misc_feature: Encodes the peptide sequence at SEQ ID NO. 87646
  misc_feature (779)..(779): n is a, c, t, g, unknown, or other
  misc_feature (780)..(780): n is a, c, t, g, unknown, or other
  misc_feature (814)..(814): n is a, c, t, g, unknown, or other
  misc_feature (817)..(817): n is a, c, t, g, unknown, or other
  misc_feature (843)..(843): n is a, c, t, g, unknown, or other
  misc_feature (844)..(844): n is a, c, t, g, unknown, or other
ctggagctccccgcggtggcggccgctctagaactagtggatcccccgggctgcaggaattcgtctcacccctagaaaaaacggcagtccgcaccgcacacacacgcacaggcagcagcacagcgatctgccttctgccccgcccccatccagcccagagcagcagcagcgcggtgccggccggcaaccgcagctggtcatcaggtctctgggcctcctcctcctcctccatcccccctcaaccctccccgtgtcggctcctcccgaatcctcacaagtagccccgcgcgccacctcgctgccggccgccggcacacagatagagaaagagagagagactgagagagagagggaggggaagcgaagagaccagaacaagagcgaagatggtcggactcctccccgagaccaatgccgcggcggagacggacgtcctcctcgacgcctgggacttcaagggccggccggccccgcgcgccaccaccggccgctggggcgccgccgccatgatcctagtggcggagctgaacgagcggctgacgacgctgggcatcgccgtgaacctggtgacgtacctgacgggcaccatgcacctgggcaacgccgagtccgccaacgtcgtcaccaacttcatgggcacctccttcatgctctgcctcctcggcggcttcgtcgccgactccttcctcggccgctacctcaccatcgccatcttcaccgccgtccaggcctcggggcgtgacgatcctgacgatctcgacggcggcgccggggctacnngcggcgtcctgctccgcgaccggcggagcgttcntcngggaagtgcgcgcgggcgtcggggcnncagctggggggg

SEQ ID NO: 87646 - protein, 156 aa, Zea mays
  misc_feature: Ceres CLONE 1574758
  misc_feature (132)..(132): Xaa is any aa, unknown, or other
  misc_feature (143)..(143): Xaa is any aa, unknown, or other
  misc_feature (144)..(144): Xaa is any aa, unknown, or other
  misc_feature (153)..(153): Xaa is any aa, unknown, or other
MVGLLPETNAAAETDVLLDAWDFKGRPAPRATTGRWGAAAMILVAELNERLTTLGIAVNLVTYLTGTMHLGNAESANVVTNFMGTSFMLCLLGGFVADSFLGRYLTIAIFTAVQASGRDDPDDLDGGAGATXGVLLRDRRSVXXGSARGRRGXSWG

SEQ ID NO: 87647 - DNA, 897 bp, Zea mays
  misc_feature: Ceres CLONE 1574761
  misc_feature: Encodes the peptide sequence at SEQ ID NO. 87648
ctccccgcggtggcggccgctctagaactagtggatcccccgggctgcaggaattcgtctcacccctagaaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgtacagttccccagtcttgctccctgcagtcctccctcctccatctcagcgttgtgttctgactcaccctgcacaatggctggtctttctgctgctggtgctccccgggctcagctatccggtttgagggctatgagaagcgccctgagatcacatctctgagggcactgtctttgtggaccccatgcagctgtttgggtgccctctccagtcccagatgactccggtctgatctgcacggtgcacatcgtgtccgacttctcaacagggatttgactcttagttcccccgagtcaagctgtcattcttccct

SEQ ID NO: 87648 - protein, 50 aa, Zea mays; identical to SEQ ID NO: 23071
  misc_feature: Ceres CLONE 1574761
  misc_feature (1)..(50): Pfam Name: AdoMetDC_leader Pfam Description: S-adenosyl-l-methionine decarboxylase leader peptide

SEQ ID NO: 87649 - DNA, 795 bp, Zea mays
  misc_feature: Ceres CLONE 1574762
  misc_feature (208)..(208): n is a, c, t, g, unknown, or other
  misc_feature (450)..(450): n is a, c, t, g, unknown, or other
ctggagctccccgcggtggcggccgctctagaatagtggatcccccgggctgcaggaattcgtctcacccctagaaaaaagccttccctgcccccggtgagctgccactgccagcttccccgtgcgcgagctgtgctgctgctcggcggcgcgcccactccccggccgctctctcgtcaccccgcctgccggtaatcggtctctatantatataggtggttcgaggtgatcggcagaaccacacaggcaaagatggcgagcgtgcacaagccaccacccttgttctcatgttctgcctgctagcgctggggagagcggagtacctcaagtacaggaccgaagcagccgtcgctgttgcatcaagacctgctgggtcggatgactctcgctgaaaagaatcggcagatgacgcagatcgagaagggaaacgccacgggccgacgcgctggnccaaaatacttcataaggtagccgtgctgaaacgggcgggaagcaaaccttgcccttgcttccctcaggggcggttttgcttcaagggctttggggcccccccctggggtggaccccaaaaaattgccaaaaaaggggccctttttttttttaagcggcgttttggggggtattaaccccgaatttctttcttacgggggatttcccaaaatgcccagtgggccaatggggggaaaaaaaaaaaaaaaagttttttttaaaaaaaaaagggccacccctaatttttttttttcccccccccccaaaaaaaaaatttttgggggggggtttttttttggagaaaaa

SEQ ID NO: 87650 - DNA, 978 bp, Zea mays
  misc_feature: Ceres CLONE 1574763
  misc_feature: Encodes the peptide sequence at SEQ ID NO. 87651
  misc_feature (432)..(432): n is a, c, t, g, unknown, or other
ctggagctccccgcggtggcggccgctctagaactagtggatcccccgggctgcaggaattcgtctcacccctagaaaaaaaaccgcgcctgtcgagctgtctcacagttaactctgtaattgtttccctttttcttcgttgctaggatcagacacaagagttttagtgatgatctcctcatcaacatctatctccatcacaagaagaaggtgtggacaggaagacgacacaagattcaggcgacactcccaccattgctgctgacggcgtccaaattgtcttctttctcccccctaccttggctggctggctctctagatcgaatcacgggtcaggcgctcccctgaccaaggccatgagccactacaccatgcatgcagccatcaactacgccgcgctgccacccacgtcgccgctgcaactcccccctncccgtactcccttcgactccctcctcgccgtttacgctaccgtcgctgttgtcgccgccgccacccgcggcggcgtcctctgacgcgggattcagagcaggatcagccccagcggccttctatcatcccgaattttggccggcatttttttcgttttccggctgctgaaccttttcttccgtttcttgtccccccggggccccgggatcccggggaacccttaggggggggaccccaaaccttcccccctccagggggaaccccgagagttgtttccccctccaaaacccggggtgaaaacaattttttttaaacccctgcggggttttctcttagcgccccggtgcgtccccccgggaaaaaaaatttttttaaggggggtgtttcccttttaattttgagaaaaaaaaccccccccccctccccaaagagaaccccctttccccagatatatataaaaagggggtgtgtgttaaaaaccaagggggggttggggagatatcctcaaaaaaaatcccccaggggggggcgccccacccctggtgg

SEQ ID NO: 87651 - protein, 52 aa, Zea mays
  misc_feature: Ceres CLONE 1574763
  misc_feature (26)..(26): Xaa is any aa, unknown, or other
MSHYTMHAAINYAALPPTSPLQLPPXRTPFDSLLAVYATVAVVAAATRGGVL

SEQ ID NO: 87652 - DNA, 1333 bp, Zea mays
  misc_feature: Ceres CLONE 1574764
  misc_feature: Encodes the peptide sequence at SEQ ID NO. 87653
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (677)..(677): n is a, c, t, g, unknown, or other
  misc_feature (712)..(712): n is a, c, t, g, unknown, or other
  misc_feature (843)..(843): n is a, c, t, g, unknown, or other
  misc_feature (937)..(937): n is a, c, t, g, unknown, or other
  misc_feature (947)..(947): n is a, c, t, g, unknown, or other
  misc_feature (1062)..(1062): n is a, c, t, g, unknown, or other
  misc_feature (1088)..(1088): n is a, c, t, g, unknown, or other
  misc_feature (1224)..(1224): n is a, c, t, g, unknown, or other
  misc_feature (1225)..(1225): n is a, c, t, g, unknown, or other
  misc_feature (1227)..(1227): n is a, c, t, g, unknown, or other
  misc_feature (1237)..(1237): n is a, c, t, g, unknown, or other
  misc_feature (1287)..(1287): n is a, c, t, g, unknown, or other
  misc_feature (1308)..(1308): n is a, c, t, g, unknown, or other
tgtttgtatgaatcttttatttctatagataccgtttatcaaaatacccccacgatgagaatattcttattttccaaaagtggagctccccgcggtggcggccgctctagaactagtggatcccccgggctgcaggaattcgtctcacccctagaaaaagcaccgctctgaaaaccattcccaggcccgcccgacttcctgcccttgtacaacgcacggtccccgtcccaatggcccagactctgtccgccgcctccgagctggccaccctgaagcgcccgttcggcaacgacgggttcggcgatggcagcaacaacggcagcgccaccggcgagaagcccaaggctcggcggcgggaggcggatccggaggcggcgctggccccggctcggcacgagttcggcgagctccgcggcttgaaccttgtccatcccaggctgtcggcgacgttcacggttatgctagccggtagtttatttccccccctgcttcgctggggagagtttgagggtttgaactggcggcgaagcacgggtcaagctaattcattagccgcttttaatccctatttggtatattggtgtataacgagataaccaacatttccgggcttttcacgccacggcccccacgnnntcttcttcttatatggaattatatctctcccgcggccatgnttctaatccgcaccctcagcacaccccggtcattnactcgcaagttctatgcactgggagctagccttcgacaaaaagttctccactatataatgacccatcttctctaaccgcgcaacccgcgtaactttatattatgcgcgatctatccaaatatcgatataancgaggtcccgatgataatatataagagatatcttaccttagatagtgtgagattagtctcttcttattctatacgattgtggtagtcgactcgnctcgctgctncagcgcttttatttaatcgtaccgttacaccctactgatatcccacacgcccagcttgtactctattgtccgacgcacatctccgcgttgtatgattaatagcgcatagtgcggnatctggacaaccacgactcgctatcntatagatcacgtattatctaccaccgccctacgcgagacgcagtattgaccgtgtatctctacattactatattatagatcttacagcgcccgccgcacatctatgcacgagagagcctgcgtcacccgtccagtnncnctgagctgantaggtcactcgtgtggacagctcgttcattataccaccggctagagcggnacacagtgtatatacgagccntctactacgcgaagtgaataaaaac

SEQ ID NO: 87653 - protein, 121 aa, Zea mays
  misc_feature: Ceres CLONE 1574764
MAQTLSAASELATLKRPFGNDGFGDGSNNGSATGEKPKARRREADPEAALAPARHEFGELRGLNLVHPRLSATFTVMLAGSLFPPLLRWGEFEGLNWRRSTGQANSLAAFNPYLVYWCITR

SEQ ID NO: 87654 - DNA, 813 bp, Zea mays
  misc_feature: Ceres CLONE 1574765
  misc_feature: Encodes the peptide sequence at SEQ ID NO. 87655
  misc_feature (492)..(492): n is a, c, t, g, unknown, or other
ctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgnagtggcgcagcaccttggcgagaaacatggtgcgcaccatcgctatgggacgggacgaaggggttcgttccgcgggccagggcggtcccttaaaactgtggtcccccccttaaaccgggccgggttggaaggggtaccccttggacccctcctaaaagtttttggggaaccccttttgttaaaaagggggaaaaaaaaaaaaaacccctttccccccccttttattgggagaaaacccccgcccctttttttagaagggggcccctttaaccaaaaaatatttttggtttccgaggaaaaaaagggggcgggggagttttt

SEQ ID NO: 87655 - protein, 226 aa, Zea mays
  misc_feature: Ceres CLONE 1574765
  misc_feature: SWISSPROT Homolog: EC 3.6.3.14 H(+)-transporting two-sector ATPase
  misc_feature (120)..(120): Xaa is any aa, unknown, or other
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLXVAQHLGEKHGAHHRYGTGRRGSFRGPGRSLKTVVPPLNRAGLEGVPLGPLLKVFGEPLLLKRGKKKKNPFPPPFIGRKPPPLFLEGGPFNQKIFLVSEEKKGAGEF

SEQ ID NO: 87656 - DNA, 885 bp, Zea mays
  misc_feature: Ceres CLONE 1574766
  misc_feature: Encodes the peptide sequence at SEQ ID NO. 87657
  misc_feature (514)..(514): n is a, c, t, g, unknown, or other
  misc_feature (815)..(815): n is a, c, t, g, unknown, or other
  misc_feature (885)..(885): n is a, c, t, g, unknown, or other
gagctccccgcggtggcggccgctctagaactagtggatcccccgggctgcaggaattcgtctcacccctagaaaaatcaccaaaaccacccagaagcctccgcttgaccgcttcactcgctttccgcccgccgcgccatgagcgccgccgcctgcctgttcgctgccgccgtctccctatcattcccgtcgacctccgcaccctcttccgcaagacgccgccgcctccggagccccaccaccctcctccgctgctccccgactcgccgccgtgggccggtccggcggacactcgacgagcggctgctcgaggccgcgccggcggagaccgaagacgtccaaaccgctgttgatgtagaggatggaggagggatcgctgagggcgatgaacccccaacagaggagatggaggagctggagcagcgaccgccgacgagggctttcgtgaagagcaggcggcagcggcaggaagaggaggaagccgcggcggggcaagaccggttcaagctcatcnatggcaaagagatatttcaagagaaggcttatctggttggtgttgagtgcaaacggacaggagggaacctgttcggcatagaggagtccctttaaggagctggagcagttggctgatacggcgggccttctggtagtcggctcaacctatcaaaagcttttctaccccaaatccaaggaacttaccttggttccaggaaagggttcttaaaatcagggactgcaatcccaggcactttggaggttggaaactggtaaattttaaaaccaatgagtttgttagtcttggaaacaaataacgnaaactttgggaaaaaattctttttgggggtgggaggggccccgaaatcctggggagatacaaacctggcn

SEQ ID NO: 87657 - protein, 156 aa, Zea mays
  misc_feature: Ceres CLONE 1574766
  misc_feature (126)..(126): Xaa is any aa, unknown, or other
MSAAACLFAAAVSLSFPSTSAPSSARRRRLRSPTTLLRCSPTRRRGPVRRTLDERLLEAAPAETEDVQTAVDVEDGGGIAEGDEPPTEEMEELEQRPPTRAFVKSRRQRQEEEEAAAGQDRFKLIXGKEIFQEKAYLVGVECKRTGGNLFGIEESL

SEQ ID NO: 87658 - DNA, 888 bp, Zea mays
  misc_feature: Ceres CLONE 1574767
  misc_feature (707)..(707): n is a, c, t, g, unknown, or other
  misc_feature (888)..(888): n is a, c, t, g, unknown, or other
ctccccgcggtggcggccgctctagaactagtggatcccccgggctgcaggaattcgtctcaccccctagaaaaaataatcgcgccgcgcaggcggcatcacactccagtacagctctcactgcgccctgcccgcatcggctccaccacgccccacgccccacgccccccacacacacacaccccgacactccggacagagggggcgcaggcacgagaacagctcagtcgcggcgagctcccgggtctccagcgaaagtgccggaggagagagtggtggcggctggcgcgggctccctccgaggctctacgcggcgcctcagcgtaatgctggccttccccggggacagatcggcctgagtcgccgttgccgctctcgaatcggcgtcttcctcgcatggttccggccagagcttggatctcgcggcggaagacgcgaggcggaaaagtggggagggtgtcgttccttggttttcttctcgccaaagaggattgaagttatgatggaaaagcttgtatagtagcgctgaatccaattctcttgaagcaagtctcaaccatgcagcgtcttacagcgatagtctttgtggctacttctttccttgttgcaagtgttccatgccaaaagtgctgatctgaactccgataagcaggctcttctcgcatttgctgcatcactgcctcatggaaggaagctcaactggagcntcaccacacctgtctgcacttcttggggtgggggtgacatgcacaccagataagagtcgtgtacatacactgcgcctacctgctgtaggacttttcagtccataccatcagacactcttgggaagctgatgcactggaagtattgagcctaagtcaaatcgccttactggtgacctccacn

SEQ ID NO: 87659 - DNA, 898 bp, Zea mays
  misc_feature: Ceres CLONE 1574770
  misc_feature: Encodes the peptide sequence at SEQ ID NO. 87660
ggagctccccgcggtggcggccgctctagaactagtggatcccccgggctgcaggaattcgtctcacccctagactagaaaaaattgtcccatcaaactcgctactggcctcgggcccgcccgtcgtgaggtccgagctcgatgcagccgatccggcggcggcaccgaggctttgcactcctctgtctctccgccgccctcctcgctgccgccactctgctccccggcgccgccgtcgccgaaggtgtcacgccctccgaggcgcgccggctccgcgacgaggtgaaagatatgttctatcatgcgtttgatggatacatgaagtatgctttcccactcgatgagctgcggcccttaagttgccaaggtgaagactcccttggtggttatgcgcccactcttatcgattctttggataccttggctttactgggtgataaggagaaatttggtgctgctgtggagtgggttggtaagaatgtccactttgatattaataaaaccgtctctgtttttgaaaccaacatacgtatccttgggggtctgctatcagctcacctgattgccagtgattatgccactgggtatgagaatccaatcttatgatggaccagttacttcatttagctggctgacttagctcaaaggttgttggcccgcatttgacactcccaacggggattcccattggaatctggttaattttattggaccgcactccagtgaaaatggaaagcaaggataacctccaccggctggtggggggggcactttcgacacttggaaattttggccttatgtgagtcccctttgaactaaaataaaactgggtattttgagcgggagttaccaaaaaaaaattatgtgcgcttggcgaatattggtctcacccccaaaa

SEQ ID NO: 87660 - protein, 154 aa, Zea mays
  misc_feature: Ceres CLONE 1574770
  misc_feature: SWISSPROT Homolog: EC 3.2.1.113 Mannosyl-oligosaccharide 1,2-alpha-mannosidase
MQPIRRRHRGFALLCLSAALLAAATLLPGAAVAEGVTPSEARRLRDEVKDMFYHAFDGYMKYAFPLDELRPLSCQGEDSLGGYAPTLIDSLDTLALLGDKEKFGAAVEWVGKNVHFDINKTVSVFETNIRILGGLLSAHLIASDYATGYENPIL

SEQ ID NO: 87661 - DNA, 653 bp, Zea mays
  misc_feature: Ceres CLONE 1574771
  misc_feature: Encodes the peptide sequence at SEQ ID NO. 87662
  misc_feature (514)..(514): n is a, c, t, g, unknown, or other
ctacccgcggtggcggccgctctagaactagtggatcccccgggctgcaggaattcgtctcacccctagaaaaaactccactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacggtgacggatgcctggctggactccatccatgcgtgcgccgacgtgctctcctcgtccctcggggggcggccacgtacgaccccgccgttcccttcgtaaaaagggccaggggttgggccggggaatgggggtgtccccgggcccccccggggggttttccccatagtgccccgccccaattccggggggtttttcccccccccggggaagaaaacccccaaaaaagntgggtgggggggagagtttaggggaaaaaaatcccccccccccccgaattttttttttgtgggggaggggggggtttttttcccccccccccccccccccccccccaaaaaaagggggggggaatataattttttcttt

SEQ ID NO: 87662 - protein, 76 aa, Zea mays
  misc_feature: Ceres CLONE 1574771
MKYSKEDKPERAGGAGAGSRAVPVALVVVVLCAFSFYLGGIYSTVTDAWLDSIHACADVLSSSLGGRPRTTPPFPS

SEQ ID NO: 87663 - DNA, 1063 bp, Zea mays
  misc_feature: Ceres CLONE 1574775
  misc_feature: Translation starting site: 157
  misc_feature: SWISSPROT Homolog: EC 1.4.1.2 Glutamate dehydrogenase
  misc_feature (790)..(790): n is a, c, t, g, unknown, or other
  misc_feature (794)..(794): n is a, c, t, g, unknown, or other
  misc_feature (1063)..(1063): n is a, c, t, g, unknown, or other
tccccgcggtggcggccgctctagaactagtggatcccccgggctgcaggaattcgtctcacccctagaaaaatctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcgggaggtccccccccccatgcgcctgtccagagtgatatcaagtcggtggccctttcaaggtcattttctgggccctggtgcggaagccaacggattggttgtccagccacaaggggtgagggaaaaagcaggtttgccggcttgaaggagaagctccctcaaatgggttccttaatccaagatggccctgaaggattgcctgaagcctttaacccttggcgtagccacccgatccaagaagaaagccgtggtggggtaaacaaaggcccccgtggcgcctaacttttacaagggaactcaccgtcgaagagcgccagggcgccacacaaacggagtgcgctggcggtcgtgagaatttgcacggggcccctttaacagggggcctagcgctttattcaccgnccanacggtgaccaccacaaggtgtagactagcctcgatcgcgcgcccgagggtgcgattgggcaacaagaaaagcgccctaccaccaaatgtctccgcggtagaagcaacaaaaaagtatcctccttaattattcggagccgttggagagaggtgcggaaacaccttttgagatgcggcacgcgcaaccgctcacacacattgacggcccagggtatatcgctttgacgagcacgcgggcgcctcatccattcgggggtgaacacgcccttn

SEQ ID NO: 87664 - DNA, 886 bp, Zea mays
  misc_feature: Ceres CLONE 1574776
  misc_feature: Encodes the peptide sequence at SEQ ID NO. 87665
  misc_feature (574)..(574): n is a, c, t, g, unknown, or other
  misc_feature (580)..(580): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
ccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggctgtcatgccacgtacctgggcgccccggtgccgtggggcacgctgccgaccatcctggtgatcgagttcgtgnccatcngcttcgccgagcaccagcgcaccatggagaaggaccccgagtaggatgtgtacccccggcgggccctcgacccgctcggctttctcaagggacccgcccagttcaagcagtacaagctcaagagatcaaaaacggccgcctcccatgtttggctttctcagctttcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 87665 - protein, 164 aa, Zea mays
  misc_feature: Ceres CLONE 1574776
  misc_feature (54)..(165): Pfam Name: Chloroa_b-bind Pfam Description: Chlorophyll A-B binding protein
  misc_feature (149)..(149): Xaa is any aa, unknown, or other
  misc_feature (151)..(151): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGCHATYLGAPVPWGTLPTILVIEFVXIXFAEHQRTMEKDPE

SEQ ID NO: 87666 - DNA, 872 bp, Zea mays
  misc_feature: Ceres CLONE 1574779
  misc_feature: Encodes the peptide sequence at SEQ ID NO. 87667
aaagctggagctccccgcggtggcggccgctctagaactagtggatcccccgggctgcaggaattcgtctcacccctagaaaaaatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcacgtcgctcgccgcgcgcctcgccaagacgccgtcctctcggcccaccttgcttgacgagagccgcgcggggtcgtcgtcgtcgtcccccgatgacgagtcgtccctcgcgtccgtgccgctcggcccgggcacgtccgtcggcgtgggcaactacgtcacccgcatgggcctcggcacgccggcccagtcgtacgtcatggtcgtggacacggggtcctcgctcacctggctccagtgctccccctgcgtcgtgtcgtgccaccgccagtccggcccggtgttcaaccacaaggcgtccagctcctacgcctccgtgtcctgcttcgcgcagcagtgcagcgacttcaccacggcacgctcgacccccgcttctggctcacctccaacgtctgcatctaccaggctcggctacggcgacagcttctttcttggtcgggtatctgagcaaggacatcggtgttgtttg

SEQ ID NO: 87667 - protein, 233 aa, Zea mays
  misc_feature: Ceres CLONE 1574779
  misc_feature: SWISSPROT Homolog: EC 3.4.23.12 Nepenthesin
MALLRLLALISLLFAVATPVRDIAHDACSSEVKDFQHLNNSSGLHLTLHHPQSPCSPAPLPADLPFSAVLAHDGARITSLAARLAKTPSSRPTLLDESRAGSSSSSPDDESSLASVPLGPGTSVGVGNYVTRMGLGTPAQSYVMVVDTGSSLTWLQCSPCVVSCHRQSGPVFNHKASSSYASVSCFAQQCSDFTTARSTPASGSPPTSASTRLGYGDSFFLGRVSEQGHRCCL

SEQ ID NO: 87668 - DNA, 912 bp, Zea mays
  misc_feature: Ceres CLONE 1574780
  misc_feature: Encodes the peptide sequence at SEQ ID NO. 87669
  misc_feature (455)..(455): n is a, c, t, g, unknown, or other
ctccccgcggtggcggccgctctagaactagtggatcccccgggctgcaggaattcgtctcacccctagaaaaactccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgccctcgtgccagggcgtgtccgccgccgcccgcgtatggagcttgcagccggggggcggagaacctgcatgtgcaggactancagggacgctacatgtattatgggtgctaccccgcttatgcctatggagcctatggtggctgggggggagtacccataccgtgagcatggatggacacagacaccaactgctgggtactattgcggacttgtactatgggctagcccccatagggggttgcacccttggggccatgatgggcaaatttatggggtcaaaaatttaccagttcccggcgcactttccccaaggaaaagaaactctcctgccaaagttgtcatccaatgggggtaaagtgaaaaattttggccccgcggccccaaaaaagaagttccccccctttgggggggggaaaaagggggaaaaaagtttttaaaaaatccaaatatccgggggcgaaaaaaaaaaccgggaaatttgcccggggttcccaaggggtcaaaatggcgccaaatttaaatggggcgggctgggcgt

SEQ ID NO: 87669 - protein, 192 aa, Zea mays
  misc_feature: Ceres CLONE 1574780
  misc_feature (75)..(75): Xaa is any aa, unknown, or other
MAAVGSLKPGMETLHVQDYKDAPPAKAAVESLQPAMESLHVQDYKDAPSCQGVSAAARVWSLQPGGGEPACAGLXGTLHVLWVLPRLCLWSLWWLGGSTHTVSMDGHRHQLLGTIADLYYGLAPIGGCTLGAMMGKFMGSKIYQFPAHFPQGKETLLPKLSSNGGKVKNFGPAAPKKKFPPFGGGKKGEKSF

SEQ ID NO: 87670 - DNA, 878 bp, Zea mays
  misc_feature: Ceres CLONE 1574781
  misc_feature: Translation starting site: 363
  misc_feature (786)..(786): n is a, c, t, g, unknown, or other
  misc_feature (813)..(813): n is a, c, t, g, unknown, or other
aagctggagctccccgcggtggcggccgctctagaactagtggatcccccgggctgcaggaattcgtctcacccctagaaaaattctaatttcactttcacctcctccgccaccagttcggggaaaaggaatttttggagaaaaatcccattggcccagcccagaatactcagccgcgcgccgcgaccttcgctcccgtctccggtctccgcctgccccccgtccccaacctatcgggagcgctcccgattcgcgggagcgagagaaatagagtgccccccgctctccgctctccgccgcggatcagcgccgtcgccgatcggaggccctcgcttccgccggcgggcggcgcgagccgggagatggacggcggcgcgggtgccggtcggaggagcgtcccctcctcctccggattcaggaggagggtcccgcccgccgagaacgggcacggccatgacgccccgccgccctccaggcggtcctccgcctccctctcccgcggccactccacgccgctgactggcgagaggaccgtgaaaaggctgaggttgtccaaggcactgacgataccggatcacacgaccgtgcacgaggcttgtcggaggatggcatcacgcagggtagatgccgtgttactgaccgactccaatgctttgctctgtgggatccttaccgacaaggacataaccacaagagtgattgctcgtgagttgaagatggaagagacactggtctccaaggtcatgactagaaaccctgtatttgttctcgcggacacgcttgccngttgaggcgttgcaaaagatggtgcanggtaagttcagacatctgcctgtttgtggagatggtgaagtcattgcaattctggacatagccaa

SEQ ID NO: 87671 - DNA, 988 bp, Zea mays
  misc_feature: Ceres CLONE 1574785
  misc_feature: Encodes the peptide sequence at SEQ ID NO. 87672
ctccccgcggtggcggccgctctagaactagtggatcccccgggctgcaggaattcgtctcacccctagaaaaaagggagctcgagaggtcaacgagggggagctggcacgaaagctcagggctccttgctcctcctataaacccagcgcacccgccttccaggctcccattttctcgcccgggagccgcaattccatcctgctgctcgagttacatactcacccaatagaacaattctatgcctgatgattgtacttccggaggtagaagatcatactgaagcagaactcgagcagtgttgaatcgaaatggaaggcaggatgacaagtttggaagcaccatgaaaagttcctcattgatggcaagcagcatgtcaaggaatgctgaccctgaccaacagactctacgccccaattcggtggagcagttttatttcccaagacctggtcaaatcttggcaaggattcctccattcttttgggctccctcctccagtttgtatcttccttattgacatgaaactaaattttggcaatccagtttgaaccaaacctttccagaatacaaaagggggatccccaggcttagtggagcaacctaacctttccttgagccaaaaaatcaaccgggaaaaaaaatttggggggcccttgaggttaacgaaaaaccccaatttctgggggggtcccgggggacctaccccaaaaaaacaccccccaaaacgggggttcccccaagaaaaaaaaaccccccctatttcccgcggggggccccccccccctctaaaaaaaaaaaacccttttttaggcaacccccgctgtgttgggggttggggaaacccttgggtttcccagggggccggggggggggtctcccccccccaactttgaaaacaaataaattttttcccacaaaaaaaaaacccgccggaagagaggaaagagagccccccccccaccaaagaaaggaaaaacaacaccccccccc

SEQ ID NO: 87672 - protein, 57 aa, Zea mays
  misc_feature: Ceres CLONE 1574785
MKSSSLMASSMSRNADPDQQTLRPNSVEQFYFPRPGQILARIPPFFWAPSSSLYLPY

SEQ ID NO: 87673 - DNA, 800 bp, Zea mays
  misc_feature: Ceres CLONE 1574786
  misc_feature: Encodes the peptide sequence at SEQ ID NO. 87674
  misc_feature (248)..(248): n is a, c, t, g, unknown, or other
  misc_feature (558)..(558): n is a, c, t, g, unknown, or other
  misc_feature (559)..(559): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
aagctggagctccaccgcggtggcggccgctctagaactagtggatcccccgggctgcaggaattcgtctcacccctagaaaaaacctcccaacccaatctcctcagtcctcactcctcagagagagccccaagccaagatctgcgcgggcaagtcaccaggcgaagcaccggctcccatggccgtggacctgatgggctgctacgccccgcgccgcgccaacgaccagctcgccatccaggaaggcnggccgccggcccgggcttccgcacctgggagctgctggtgacgtcctgtcaccaagcgcccgccccaaaggcccttgaataccgttcgggaaatccccggccgggcttttccaaatcccaagggaatttcactcttaaaccccggggggacccccctttcccccgggggccttaaaaaatttcccccccccggggcccccttttttttcccgggggcccccctaaagggggggcaaccccccccccaaaactttcgtctgggtttttttaaaaaaaaaactttgtgggggggggggggggccccaacccnnaacccaccccaccccgtttttttttttttttnnnaaaacacgcggggggggggggaggttttttttttttgggggggggggagttatttttttttttttttgaaaaaaacaccccctctttttttgttaaaaaaaaaaaaaaaaaaaattatttgggggggcccccctccttcttgggggggccccaccccaaaaaagaaaaagtgttttttttttttttcctcttataaaaacaaaagaa

SEQ ID NO: 87674 - protein, 36 aa, Zea mays
  misc_feature: Ceres CLONE 1574786
  misc_feature (24)..(24): Xaa is any aa, unknown, or other
MAVDLMGCYAPRRANDQLAIQEGXPPARASAPGSCW

SEQ ID NO: 87675 - DNA, 940 bp, Zea mays
  misc_feature: Ceres CLONE 1574787
  misc_feature: Encodes the peptide sequence at SEQ ID NO. 87676
ctcaccgcggtggcggccgctctagaactagtggatcccccgggctgcaggaattcgtctcacccctagaaaaagccaaaggggaagccctgcccgtacttccgttgcggcgctacgagcttcgacgggcctcgatctccacctctgaagtgactacttgtgatctagatctgaagctgtagtggtcagcagcttagtgtgaatcgaagatgagcgtggtggggttcgacctcggcaatgagagctgtatcgtggcggttgcgcggcagcgtggcatcgacgtggttctcaacgaggagtccaagcgcgagacacccgccatcgtttgcttcggggacaagcagcggttcatcggcaccgccggcgccgcgtcctccaccatgaaccccaaaaactccatctctcagattaagcgcctgctcggccgcaagttctcagatcccgagctgcagcgcgatctcgcctccttcccattccgagtcacggagggccccgatgggtttcccctggtccatgtacggtacctgggcgaggagcggacgttccacctcccccagctgcttgccctgggggtgtccaatttgaagggctttgctgaggggaaacctgatggccccagtggttgattgttgcattgggatccccgggcctatttcaaaaattttgaagccaaggggtggtcctaatgccgcccacatttggcgggtccccggccatttggaattgttccctaaaaaaacaacccacggcctctggggatatgggttttttaaaaagggtccccccaaaaaaacaccagggaaaggggccttttgggcataaacggcccgcaacaccgcgggtttttttttgtcgtttacaggagggaaccccccaaggtttgttccaaatataaaacggttcttgtggtggaggaagtcttcaagagcccgctttttag

SEQ ID NO: 87676 - protein, 138 aa, Zea mays
  misc_feature: Ceres CLONE 1574787
MSVVGFDLGNESCIVAVARQRGIDVVLNEESKRETPAIVCFGDKQRFIGTAGAASSTMNPKNSISQIKRLLGRKFSDPELQRDLASFPFRVTEGPDGFPLVHVRYLGEERTFHLPQLLALGVSNLKGFAEGKPDGPSG

SEQ ID NO: 87677 - DNA, 897 bp, Zea mays
  misc_feature: Ceres CLONE 1574788
  misc_feature: Translation starting site: 306
tggagctccccgcggtggcggccgctctagaactagtggatcccccgggctgcaggaattcgtctcacccctagaaaaattctgcctcgctgcgccggcctcccaatcgatcgaggcggcgcagagcagaggaaaaccccgagccgcaaccctcctcaccgcacagcagctcgagtactcgttctcttccgcatcctcctcctcgtcaactccagtcgtattcagcccttcaccacaatcaggcccacctcccaccaccacatttcttctcatccaaccgccccgtaggatcacagagaagggggatggcgagcggcggggcggtgagggatgtgggctcgcctgcggagctggaggcggcggtggccggggcgcgggcggtggccgtgcacttctgggcgtcctggtgcgaggcgtccaagcagatggacgaggtcttcgcgcacctcgccgtcgacttcccccacgcagccttcctgcgggttgaagctgaagaacacctgaaatatcagaggcatatggagttacagcggttccatattttgttttctgcagggaggaaaaattgttgatactttgggagggagtaaacccagccagcctggccaataagggtgcaaaagtagctgggccctgctagtgttgctgagtctgctgtacctgctagccttggagtcgctgctggggcctgctggtacttgaaacatccaaaagatggcacagcaaaatggatccctctgctggctgaaagcacaactctggcagtactccagatgcattgaataagcgattggagcagcttgtcaattccccatcctgtgttttttatttatgagggaacccggaaacaaccagggttggtttcagccgatagtgggtcacattttgaagcaagag

SEQ ID NO: 87678 - DNA, 693 bp, Zea mays
  misc_feature: Ceres CLONE 1574790
  misc_feature: Encodes the peptide sequence at SEQ ID NO. 87679
  misc_feature (349)..(349): n is a, c, t, g, unknown, or other
ctggagctccccgcggtggcggccgctctagaactagtggatcccccgggctgcaggaattcgtctcacccctagaaaaaaccttcaagcgtcaagtagcaaaactacagctttccttcacccccagcaagaaaaccgagcgatctagcagactaccacagaagatttcctactcggccgcacgtgcagaccctgatctgactgagagaggcaggcagcagctcgatcggcagtaaccgtgagcgagccatgggactggcctggatggtgacggcggccgtcgcggcggtgctggcgtcgtgggcgttcaacgcgctggttcacctcgtctggcgtccctacgccatcnaccgggaggcctccccccccagggcgtggccccgggccccccctaaaagttcttttaccgggggagcccccggggaaaaaactaaagggggttccccccgcccaagggggggcccacccccctcccccccggggggagggttgtaaaaaaaaaccccgaattttttttttccccccccgtggggggggggggggcccccccccttttttgtggggaaaaaaaagtgggtttcccccccccccccctccctcaggggggggggggggaaaaataaactcccctggggtgttttttttgggggggagaaaaaaaccccccccccccccaaagaaaggagggaacat

SEQ ID NO: 87679 - protein, 81 aa, Zea mays
  misc_feature: Ceres CLONE 1574790
  misc_feature (34)..(34): Xaa is any aa, unknown, or other
MGLAWMVTAAVAAVLASWAFNALVHLVWRPYAIXREASPPRAWPRAPPKSSFTGGAPGEKTKGGSPRPRGGPPPSPPGGGL

SEQ ID NO: 87680 - DNA, 995 bp, Zea mays
  misc_feature: Ceres CLONE 1574791
  misc_feature: Encodes the peptide sequence at SEQ ID NO. 87681
  misc_feature (436)..(436): n is a, c, t, g, unknown, or other
  misc_feature (946)..(946): n is a, c, t, g, unknown, or other
  misc_feature (995)..(995): n is a, c, t, g, unknown, or other
tacccgcggtggcggccgctctagaactagtggatcccccgggctgcaggaattcgtctcacccctagaaaaagcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccggagtcccagcgcccggggacgacacgtcgcccaaattcctgggcgtggagacgaagacaatcaanaagatcgtgcccctggggctcatgttcttctgcatcctcttcaactacaccatcctgcggggataccaagagacgtgctcgttcgtcaccgcccaaggggcagcaggcccctaaaaataatccccgttccctcaggaacctggggtaaaaccctggcccatgggaaaaagcgggattctatggagctcctccgacaaccaaaaagttttgcccgtaataaccccttcctccacaagaggagggggggtttccttatatacgacccggtacattcttgcgccaggatcagttgagccctatcatttgggaaggctctttaggcccgacacggggcgcgttacacgcatatgggagtgaagggcgaggcaagccttggaactgggggatgggtccggaggaggctttatgtgaggttcgatatggggggccccagattttgtttagggggccccgggatgtcatcgcctccagaagcgtcgggagagtgttaattcatctatcttagaatanagggggccgccaacttgttagtcgagttggtttcgcgcgtgagccgatn

SEQ ID NO: 87681 - protein, 136 aa, Zea mays
  misc_feature: Ceres CLONE 1574791
  misc_feature (99)..(99): Xaa is any aa, unknown, or other
MESGLVASHRLRVPPPSASAGHHHLIRHRHAHAPVAAAPLRLSLPRHLPRSTPLRLPAALPLRHCLPPLRAASAAAAGVPAPGDDTSPKFLGVETKTIXKIVPLGLMFFCILFNYTILRGYQETCSFVTAQGAAGP

SEQ ID NO: 87682 - DNA, 1035 bp, Zea mays
  misc_feature: Ceres CLONE 1574793
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (147)..(147): n is a, c, t, g, unknown, or other
  misc_feature (148)..(148): n is a, c, t, g, unknown, or other
  misc_feature (163)..(163): n is a, c, t, g, unknown, or other
  misc_feature (165)..(165): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (198)..(198): n is a, c, t, g, unknown, or other
  misc_feature (200)..(200): n is a, c, t, g, unknown, or other
  misc_feature (202)..(202): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (281)..(281): n is a, c, t, g, unknown, or other
  misc_feature (309)..(309): n is a, c, t, g, unknown, or other
  misc_feature (438)..(438): n is a, c, t, g, unknown, or other
  misc_feature (442)..(442): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccnnnnggnngggggggggggggcngncnnncnnnnnnnnnnnnnnnnggggnnnnnccncncncnnnnnnnnnnnnnnnnnnnnnnntnnnnnnnttttttttcaaagctgggactccacctcggttggcggccgtctctanaactagtggatcccccggtgctgcaggnaattcgtctcacccctagaaaaactgtgagagcttcagttcacctgccaccgcctaccgagaagagatcagcgccgccgcgcgcgaagtgcttcactggggtagaagcggaacccttgctgatattggncggncgtgcccctgcggctcacgagctctccctcgttgctcttacccgggctggggctgtcttcttccgcttacgtctttcccccataacgggcctggtttcttcccttgggaaaaaacgggtggctttgcccccttcccggggccattctttttttcgaaaaaaaaaaccccgattttttttgaaagggcccctttccccgttttttcccttcccccgtggggaaaaaaaaaaacccccctttttaaattttttcaggggggtcccccttgaggagaatttttttttcccccccaaaaattaccccttgaggaatttgcccaaaaaaaaaccgttttttttttttctccccccccccccccaaatttttttttttttttgggccccccccccccctataatttttttttttttttcccccccggaaaaaaaaaaaaaaagggttgggtgtcccccccccccagggggggggggggaaaaacccccccgcgaaaaaaaaaaaataattggggcccccccaacccnnnnaagagaggggggggcccccccccaccccccccgccccctttctcttttgtgggggaaaaaaatatttaa

SEQ ID NO: 87683 - DNA, 951 bp, Zea mays
  misc_feature: Ceres CLONE 1574795
  misc_feature: Encodes the peptide sequence at SEQ ID NO. 87684
ggagctccccgcggtggcggccgctctagaactagtggatcccccgggctgcaggaattcgtctcacccctagaaaaaactgtgagagcttcagttcacctgtccaccgcctacagagaagagatctgcgccggcgcgcgctaagtgcttcactggggtagagcgtagccttgctgaacttggacggccgtgcccggtggtgtcacgagctctccctcgttgctctgcgccggggctgggccttgttcctcgtaagcgtacatgctcgacggagactcggcgcctgttcgatgcacgtgcgaaacaacggtggactgcgcggatcagggggccactcgctcggcgcgaacgagagctcggattgtttatgaagcctcttccgatgtcctctctcccccacccagcgaaatacctcttgaaattgcaaggcttcgcttgaggatcttgctctccagagctcatctgagttccatatccgtttcgtccccgccactattttggtgcgctcgcgagattctgtgtcacgctataaaagccggtgtgctccatagagtcggacatcctggaatgctgctgcgctaaagaagatcgaagacacgcgcgctcatgaacgggctgatgacgaagaatctggggctcagctcttggcacgcgcgtccgttcggtgaccaccgctggctgctccactaccgcgcctccatgctcgtcacggtcactctcgctctggacgccctttgttttctcttatcgccgccgttaccgggggggcgccagcaaaacggggcttgttcttagtagtacccctggtccttactggtacgacggaggcacagtggacaaggtggcgacagaggcccctctcgttggaggggggttattacaaaacccggtttgcctggaagataaccccgccagcgaaatcttgggtactaagaaaccctgacgtacgcc

SEQ ID NO: 87684 - protein, 47 aa, Zea mays
  misc_feature: Ceres CLONE 1574795
GAPRGGGRSRTSGSPGLQEFVSPLEKTVRASVHLSTAYREEICAGAR

SEQ ID NO: 87685 - DNA, 927 bp, Zea mays
  misc_feature: Ceres CLONE 1574797
  misc_feature: Encodes the peptide sequence at SEQ ID NO. 87686
  misc_feature (867)..(867): n is a, c, t, g, unknown, or other
gaagctggagctccccgcggtggcggccgctctagaactagtggatcccccgggctgcaggaattcgtctcacccctagaaaaactcttccccagatctggtggggaagaaccctacctcacgtcccggatcccatccggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgcgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaagccaggatacgagcgcctttgctgccttcggtgcatacagacacgtgaccacaactttgcaacgacttgtgtctgccgagtccccaagcatctgagggaagagcaagtgatagaatgtgtccattgcggctgcaggggttgtgccagcggtgactaatcttgtcatcatgttgtttggctcacgactcatcaccatccctaccacattaagggctggtcggttattcccaatacacatggnattggatgggaatggggaaaaatttatgaagaagtttgacttgtttgggaatttaaactt

SEQ ID NO: 87686 - protein, 145 aa, Zea mays
  misc_feature: Ceres CLONE 1574797
  misc_feature (1)..(143): Pfam Name: G10 Pfam Description: G10 protein
MPKIKTSRVKYPEGWELIEPTIRELDAKMREAENDPHDGKRKCEALWPIFRISHQRSRYIYDLYYRRKEISRELYEFCLDQSYADRNLIAKWKKPGYERLCCLRCIQTRDHNFATTCVCRVPKHLREEQVIECVHCGCRGCASGD

SEQ ID NO: 87687 - DNA, 916 bp, Zea mays
  misc_feature: Ceres CLONE 1574802
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (322)..(322): n is a, c, t, g, unknown, or other
  misc_feature (844)..(844): n is a, c, t, g, unknown, or other
aagctggagctccccgcggtggcggccgctctagaactagtggatcccccgggctgcaggaattcgtctcacccctagaaaaaacgagacaaaagacgcccgccccggccggcgaccagtacctcgccattgctagtgctagccgccgtcgctggtgtcccctcctcccacttgcgccgcctgtccccgcgccctcgaaacctttttctcccaaaacagatttcgtcccggcgctctcctgcaaagggcggctagctgtcgccggtgatacgtttcacctctgtctcactgctgggggggtnnnctgctctcctgctttccnaggagagggcagcagccgacgaagcgagcaaagcccgcaggaaccgcctcggcctggtgattttaagggggcaagttcgtgttcttggggaggcggaaaaacccgaaacccctcccctttccgggcccctttcccccggggtttctctcttttttttggttcccaaagggaaaaaacccctccggggtatggaaaaatggcggaagggaaaacccccggaaaaaaaaaacctctccccccccctggagaaaacccccccgggggttttaaaaattttttttaacccccccaccccccccccggggggggggagagaaaaataaatgggggtttcccaaaacacaaaaaaatttgtgttggtggcccccccggaaaaataaacccccccccggtggtgtttttctcaccaaaggggcgggccaaaaaaaaaaaaaaaaaaaaaccgggggggggaaaaacaccccttttttttttttttgggggaagaaaaaaaaaaatctttgtgttttccttctttttatnaaaacccgcccccgcaaaaaaaaaaaagggggttttcccccccaccttttctccccaaaaaaaaaagaaaag

SEQ ID NO: 87688 - DNA, 803 bp, Zea mays
  misc_feature: Ceres CLONE 1574805
  misc_feature: Translation starting site: 89
ctccccgcggtggcggccgctctagaactagtggatcccccgggctgcaggaattcgtctcacccctagaaaaaacaccaacccagccatggccaaggcagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagaggggaggggggagaaccccatgatgacacccctgccctacatcatcatcttcggcatgtccacccccttcgtcatcctcgccatcgccttcgccaatggctggatcaaggtccctgtgcgatgaccgtaacgcgatcagccagcctggatcatagatgctgactcgtcagcctgcatctcatccagcgtgtgtcctgcgactttgtaccttcatatatagagacaagagttcttgcgtgtgagcatatttgcatgatcgcctggtgtatggtaacccgaaactggttaactttttcgaaaaaaattacaatcttcaaatccttaaaaaaaaaaacaagcccccaccccatcgaaagttaattccccccttaaattgggggggggcccccaatttcccccacccgggttggtgggagggaaaatcccctctttggggaacaccccccccccctctataaacaccaaaaattgtttttt

SEQ ID NO: 87689 - DNA, 956 bp, Zea mays
  misc_feature: Ceres CLONE 1574806
  misc_feature: Encodes the peptide sequence at SEQ ID NO. 87690
  misc_feature (472)..(472): n is a, c, t, g, unknown, or other
ctggagctccccgcggtggcggccgctctagaactagtggatcccccgggctgcaggaattcgtctcacccctagaaaaagactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttattttacttattccgtgggtcggaagcggggcaccgcccctccttttggctccaaggcccggcctcgccggggcgatccgggcggaagacattgtcagggtgggggagtttggctggggcggcacatctgttaaagataacgcanggtgtctaagatgagctcaacgagacagaaaatctcgtgtgaacaaaaaggtaaaagcccgtttgattctgatttccagtacaaatacgaaccctggaaagcgtggcccttcgatcccttaaaaccctcggaatttgaaacccaagggggcccaaaaaagtccccccgggggtaaactggttttgggggacccaaaagtttattaaggaccttcctttttaaaccctccaaagggcgcccccccctttcttgggggaaaaaatccccacaggttggattgttccccccccaaaaagaaaaacgggcggggtttaaacccccggaaaaaaggtttttttccccccaggaagacaccccgcgtttatttttcccccctgggaaaagaaacggttttccacaagtgtttcccccccgtggttaaaaaaaggggggaaaaaccccgggggcgttaaatataacacccccctaataataaaaaaaaacc

SEQ ID NO: 87690 - protein, 55 aa, Zea mays; identical to SEQ ID NO: 82409
  misc_feature: Ceres CLONE 1574806

SEQ ID NO: 87691 - DNA, 937 bp, Zea mays
  misc_feature: Ceres CLONE 1574808
  misc_feature: Encodes the peptide sequence at SEQ ID NO. 87692
  misc_feature (405)..(405): n is a, c, t, g, unknown, or other
ctggagctccccgcggtggcggccgctctagaactagtggatcccccgggctgcaggaattcgtctcacccctagaaaaaaagaagagcggacctttcccgagctattcttgtagagcatcgtcacatagtagttaccagcagtactactcttgtgttagtagcttgtaatttcccccagctagttagctagctagtttctacttacgttcgcgcgcgctcatatgcgcacgtacgtgtccgggtccgcaatggagtcagaaggagggctgcttgtccgctcctcccagaacggagaggagcctgtgcatgcctgcgccgtcgcgctgacccgctgaaatggggcaaggccgcggagggcctgtcctggagccacctggacgaggtgaagcggatggtggccganccccgcgagccgctggtgaagatacagggcgccagcctgtacgtctcgcaagtggcctccgtgggcttgcgcctcaggcggcggaaaagtccccctgaagatagacgattcggctcgcgaaggggtctagggcagcaaccaactgggggttgggggggcttgatgaaaggggcccgaaaggttgggggatatgggccgggctttggggggataccttgcaagggggggaaaaaaagataagggggccccgcccccaaagggaagcccaacaaaattcccaaaggggggggggtttaggaacttgggcccaaaaggccctgtggggacggggggaaggaaaccccgggggaaatatggggggctcaaaaccccccccaagggttttggggggccccgtttcaaacccctggggaatgcgcaaggtggaaaaccaaaaaaaagggggtgggccccgggggaccctcccggggaggggacgcctctccccaaaattcggctcttttggggcggaaaaaaatggggggccccggtg

SEQ ID NO: 87692 - protein, 83 aa, Zea mays
  misc_feature: Ceres CLONE 1574808
  misc_feature (4)..(4): Xaa is any aa, unknown, or other
MVAXPREPLVKIQGASLYVSQVASVGLRLRRRKSPPEDRRFGSRRGLGQQPTGGWGGLMKGARKVGGYGPGFGGIPCKGGKKR

SEQ ID NO: 87693 - DNA, 897 bp, Zea mays
  misc_feature: Ceres CLONE 1574810
  misc_feature: Encodes the peptide sequence at SEQ ID NO. 87694
ctccccgcggtggcggccgctctagaactagtggatcccccgggctgcaggaattcgtctcacccctagaaaaaaaaaaaagaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccacaatcgcggggctggtgcttggccctctccctgtcggcgcatgggccttcctcgggctcacagccgccgtcgccactcgcacgctccccttcaccgccgccttctccgccttcaccaacgaggtcatctggctcatcgtcatttccttcttcttcgcgcgcgggttcgtcaagacaggcctcggcgaccgaatcgccacctacttcgtcaagtggctcgggagcagcacgctgggcctttcctacgggcttaccctcagcgaggcctgcatcgcgccagccatgcccagcaccacggcgaaggccggaaggcgtgtcctacctatcatcaagtcgctctcgctgtcggctgagagcagccccaacatcatcgtcgcggaagcttgggtcctatcttgtgatgacgt

SEQ ID NO: 87694 - protein, 258 aa, Zea mays
  misc_feature: Ceres CLONE 1574810
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPRPVEVSPQAWQLLSIFLSTIAGLVLGPLPVGAWAFLGLTAAVATRTLPFTAAFSAFTNEVIWLIVISFFFARGFVKTGLGDRIATYFVKWLGSSTLGLSYGLTLSEACIAPAMPSTTAKAGRRVLPIIKSLSLSAESSPNIIVAEAWVLSCDD

SEQ ID NO: 87695 - DNA, 898 bp, Zea mays
  misc_feature: Ceres CLONE 1574812
  misc_feature: Encodes the peptide sequence at SEQ ID NO. 87696
  misc_feature (639)..(639): n is a, c, t, g, unknown, or other
  misc_feature (679)..(679): n is a, c, t, g, unknown, or other
  misc_feature (680)..(680): n is a, c, t, g, unknown, or other
  misc_feature (756)..(756): n is a, c, t, g, unknown, or other
  misc_feature (819)..(819): n is a, c, t, g, unknown, or other
  misc_feature (820)..(820): n is a, c, t, g, unknown, or other
  misc_feature (866)..(866): n is a, c, t, g, unknown, or other
aaagctggagctccccgcggtggcggccgctctagaactagtggatcccccgggctgcaggaattcgtctcacccctagaaaaaaacgcctcctcctgcaccagagccaaggagacggggagtgtgcatgctggggtgatgaagctgcaaaccttccggagcgggggcgaagcataggcagccagaggagagggtacgcgagagcgtgattgcaccgggagctggtggcggagctgagccgggccggattaggatcagctaaactaatctcacaaaaactggccacgcaaccttgaaggctcgatcacgcgagctgagagagcggaggagtccgctcggaggggaggaaagggcggagggaagaggagacggagcgaggagtccggtttctgttgagcggaaaccgtgtagagattagatttttagatctaacggacttgcacgctttataagtctgcccacgacacgatctaactcgagtcgagtcctcttctatttgagggaacgatcaaatacgcgtacacggccggtatccacagcgccggcacggcgcacctcctctcggagaatcgaagccgaactgggcggcgggcgtaatggatctgctgaagcgggaactggagaagaaagcggaaggcngcgacggccgacttcgggggcaaagagctttcgtgcggcnngctcgagctggagcagaagcagctccagaagcgccgcgacgagcaacgccagctcctcgccaagtccggcacgtcngcgccctccgcgaattccgccgcagctgctaccggttccgacccaggcagcctcacgttgcannttttaaaaaagggggggggggaacccttaactttaggttcctcggncggcggcaacttctttggggccccttcggtcc

SEQ ID NO: 87696 - protein, 58 aa, Zea mays
  misc_feature: Ceres CLONE 1574812
KAGAPRGGGRSRTSGSPGLQEFVSPLEKNASSCTRAKETGSVHAGVMKLQTFRSGGEA

SEQ ID NO: 87697 - DNA, 807 bp, Zea mays
  misc_feature: Ceres CLONE 1574813
  misc_feature: Encodes the peptide sequence at SEQ ID NO. 87698
  misc_feature (503)..(503): n is a, c, t, g, unknown, or other
ctcaccgcggtggcggccgctctagaactagtggatcccccgggctgcaggaattcgtctcacccctagaaaaaaccgtccaccatcaccgcctcgtgtgcagcgtgctcgctcacctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcgggcgttggagcccggggaagacgtgtggggtcgacgtcgacgtgctcatgacccacgacggtctgcgggccggcggcntcgaaatcttaaaaaagagttcggggaggaccccagggtcttggtacgccaagaacccgtcgtcatcccgggaacattaaatttttaccaagggaaggaccgggccaaaccggaaagggtgaaaatccctagggggaatttttggggggggaacaaaaaaaccaaagggactttcctttaacaatcaaggggccccccccgggatttttcgggggggttatttccgggaaacaaaaaaaggggggtgggggcccaaaactccactttttgtttaggagagaggggccctcgcgcaaaccaaaat

SEQ ID NO: 87698 - protein, 92 aa, Zea mays
  misc_feature: Ceres CLONE 1574813
MASSVSAAAKAAAAFAHKVQKELAAPAQRRAGLTRRTKPCSVRAVASPARALSSTGSVKSAMTMTEKILARASERAGVGARGRRVGSTSTCS

SEQ ID NO: 87699 - DNA, 892 bp, Zea mays
  misc_feature: Ceres CLONE 1574816
  misc_feature: Encodes the peptide sequence at SEQ ID NO. 87700
  misc_feature (892)..(892): n is a, c, t, g, unknown, or other
ctggagctccccgcggtggcggccgctctagaactagtggatcccccgggctgcaggaattcgtctcacccctagaaaaagcaccacgcaaaccgagctcgagaacaccaccacgaacaagaaagaaacacggccgcgacggggcggggcggggcggcttctccttttccaactcgctgcccgttgcgtgataccaccgcgtcgcgtcgcgtgtgcatttgcgcgcgcacacagcagccgccgctccgatcgccctgaaaaaggtgccaattgttactgattgcagataggtgttcctacacagggactaactgccccgcgaccttcttcagcaatcttatgctcatgtctcacactaaacagatggctaatagtaggaagcctcgtggcctcacgttactcagaggcgccggctcactgagaacgtaccagacactagtcctggtcctcacgttcttggcgtacgcatgcttccagatgactcggaagatcccaagcatacccgagagcgctcgggacccgcacgagaaggtggggttctctcactggggacggttgcacgccagcaaagagctctcatccaccgctgggtggcgttcaagatcgccgacggatccgcgctgttacgagaggtagacctcgcgttccttggcgggaattgcgtcgggatgttctctctccggcccacatcgggaaaccgcatgggatctaagggttttccataaccggtgggatggcccggccaccgccgtgtttcccaaacgctccttgggggttggaatactgggctgaacttcccaccggtttctaggaattttctggggccattccaaaggggtttcctggcccgctttctctaaacaatgggctggggcccttacgcgggttctcn

SEQ ID NO: 87700 - protein, 96 aa, Zea mays
  misc_feature: Ceres CLONE 1574816
MSHTKQMANSRKPRGLTLLRGAGSLRTYQTLVLVLTFLAYACFQMTRKIPSIPESARDPHEKVGFSHWGRLHASKELSSTAGWRSRSPTDPRCYER

SEQ ID NO: 87701 - DNA, 1009 bp, Zea mays
  misc_feature: Ceres CLONE 1574817
  misc_feature: Encodes the peptide sequence at SEQ ID NO. 87702
ggagctccccgcggtggcggccgctctagaactagtggatcccccgggctgcaggaattcgtctcacccctagaaaaaaaaaagtaccctcgatctccaaccggttcaccactcaccactcaacagccctcccctctcatcatctcctccccccgcacctgcacagcctctcccgccgcccgccgcgcgccgcctccgcgcgccatccagacgccagtgcgcgtcgcggtccgctgcccgcgctggtgttacacacgtgtaacaatacattacatggcgctagtacagttcaatggtgccttgcttccccaactcggtgaaaaacctcggacgctatcctcgccgcctgcagttgcaagggctacctatgccgatgcaaggttcctggcaccggacaccaccctcaagaggtagaggtaaacacctgctatcatctagttatagtttgcattcgcagacctcttctgaacaaataaaccatgtaccgtcgtcaaagatctcgccagaaaaagggctcaagtttttgtcgtcagagctgaagctgaatttctataaacgacttggtggctcaaaaaaagctaggtaaacctgaaaacagagccgcccaacggaaaccttgctaggagctatcatcccagaaggtaacaaaaaacccgggtgccgaaccaaaaagttcagggaaaatcccccaaggctttaagagagttttggcccgaatgaagaaaaaacccacccacccctgatataaaatatggagaaaaccgggcctaaaggggcccggcttgggccacagaaaattaccaaaaccgctttgaaatttttcaaaaccccggtttaaagaattcgcggggaagaggggaaaaaaggtgggggggccttcccccccctaaaaaaaaaattggggggggtaataataaacccaaaagcggggacaaatttataaaaaaacgggtgtttggtggggaaaaaaaatttgtgaacaccagtgtggggagggtttccacggggg

SEQ ID NO: 87702 - protein, 46 aa, Zea mays
  misc_feature: Ceres CLONE 1574817
MALVQFNGALLPQLGEKPRTLSSPPAVARATYADARFLAPDTTLKR

SEQ ID NO: 87703 - DNA, 915 bp, Zea mays
  misc_feature: Ceres CLONE 1574819
  misc_feature: Encodes the peptide sequence at SEQ ID NO. 87704
  misc_feature (759)..(759): n is a, c, t, g, unknown, or other
ctggagctccccgcggtggcggccgctctagaactagtggatcccccgggctgcaggaattcgtctcacccctagaaaaaggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcatggggccgggacagctgactagctgacaggcatggggatggacgcctgcggcggcaagctgccgtacatctacgccggccaccaggactgcgggaagctggtgaagagcgtcagcagcgtggagccgcgcaggttcggcctgggcctcgtggcgggcttcatcgtcgtgaccagcccccacttctccaccgccaagttcgacgccatccagatcgccatgaccagccgacccgtctccagcaatgcggacggcgtcagagtccgctctctgggagtgggcgcctcctccgccgacaccttcaacgcctccaggcagggattagatttgggcgcgatgtccatggccgtagaggggagcgaggccaatgcgctcgagaaagacggcggccaagcctcttcaccttcggggccaagttcttggtcaggaattgcttgcagctctccttcctcccatgtcgtcagaggagccgcgaacagcatccaggaatcagggcgtcttgaagacgaggagctacaaggggcacgatgccattttncatggtttcaagaagagcaaagaatccgccgccgccaaacccagcggccaatgtcagctcccccctctgtggttcactctccaccatgccatcctccctggttcccgcggaaggggattctccagggtttagccatccgaactcgcgaaaccaccc

SEQ ID NO: 87704 - protein, 220 aa, Zea mays
  misc_feature: Ceres CLONE 1574819
  misc_feature (169)..(169): Xaa is any aa, unknown, or other
MGMDACGGKLPYIYAGHQDCGKLVKSVSSVEPRRFGLGLVAGFIVVTSPHFSTAKFDAIQIAMTSRPVSSNADGVRVRSLGVGASSADTFNASRQGLDLGAMSMAVEGSEANALEKDGGQASSPSGPSSWSGIACSSPSSHVVRGAANSIQESGRLEDEELQGARCHFXWFQEEQRIRRRQTQRPMSAPPSVVHSPPCHPPWFPRKGILQGLAIRTRETT

SEQ ID NO: 87705 - DNA, 696 bp, Zea mays
  misc_feature: Ceres CLONE 1574820
  misc_feature (245)..(245): n is a, c, t, g, unknown, or other
  misc_feature (269)..(269): n is a, c, t, g, unknown, or other
  misc_feature (367)..(367): n is a, c, t, g, unknown, or other
ctggagctccccgcggtggcggccgctctagaactagtggatcccccgggctgcaggaattcgtctcacccctagaaaaaaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttngaagggggagaaaagttagatctngttccacagattcacggcgtgcgcgctcgcgatcgggggtcaccctagctcgccgtttgaattgagtactagggagtctagggtggaaaagtctacanattctttccagagtttgactctccttggttacgcttggggctttcccttccggaggcccaaaaaattcagttggggttttccccaggggaaaaaacccccccggaacccctttggggcccccccccaaaaagaaggggtttttttttaggacctggtttttttaaaaccccccggggggggtgtttttttagaaaaaaacaaaaatcccccctttttgttctcggggggagccccccccttttttttagaggggggggtttgttttcccccccccccccccccgggggggggtgttttttttttcggggggggggcccccccccccccc

SEQ ID NO: 87706 - DNA, 1009 bp, Zea mays
  misc_feature: Ceres CLONE 1574821
  misc_feature (1009)..(1009): n is a, c, t, g, unknown, or other
ctccccgcggtggcggccgctctagaactagtggatcccccgggctgcaggaattcgtctcacccctagaaaaaatttctgaaagggtagccccccttatcaggccttcggacaagcctgaagaagataacgtatgatctagctgtagttatattgcgcacattgcattcacgcgctgtttgcacacaggccacacacgcatgcgaattatttgttcaaaaggaattgctagcgcgtcttgattatattgctacttataacttttactacttggtgcactggcgagagatgtctcatataccaggttgcgggtttcaagtggccccgtttttattatcgtgatttgtgaagggtattagatatcatctcggccaacatttacgatcaatggcccaggtaagtatgtgggttgccttacaaaataacctccataaaggcccagcccggcccggctgggccggtaacaagtcagcccagcccagcccagcccttggaaaacggcgctcctttcctcctcaatggggcgctgggccccttggggggcccctccgtccccccgtctctcctggcctccctgggggaaaccgggttccttttatcgggaaaaattggcccctcgggggcccgccggggggggttctccccggggggggggggaaaaccctggttttcaacagtggaaaaccccgtgggcgggtgccgggggcccaacccacaaaaattggggcccccccccggtaaaggggcccccattataaggacgggggggggcgttgaggcacctcctcccccccaagggggggggtgtgctcccccctcggaagactgcgccacaggaggggtgttttcaaaaccacccaaaaacaaagaatctctccacaacccgttttgtgggagaccccctcctcacgaagaatatttttcccagaggggggcgcagaaacacttattgtgtgggcgaataaaggcccccccataaaaaagaggggggggcgcacgctctcccccn

SEQ ID NO: 87707 - DNA, 957 bp, Zea mays
  misc_feature: Ceres CLONE 1574826
  misc_feature: Encodes the peptide sequence at SEQ ID NO. 87708
ctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagccccacccccatgaccaagtccgaccttgtcaacaacctcggttacatcgccaggtccgggaccaaggagttcatggaagccccttgctgccggcgctgatgtgtccctgatttggccagttcggggtcgggtttctactcctgcctacctcgtcgccgattgagttgtcgtgacccccaagcccaacgatgacaagcagaccgggtgggagcccccaagcgggcgggtcgttccctgttactcggaaaacgtcaggggaaacacttggcaggggccacaaaatcccctggtccccaaggaaaattagctgggatcccggaggaacggccccccaaggaaccggccaagaaaacctgaattttttaggttcccccttcccccggggggtggaaaaaaccaccgaaagggaatttttcgtcccccaaacccggtaaaaaaaaatttcctcaaaagaaaatgtttgaattttttttcctctgcgcctatacaaatagtaaaaggtgtcccggggggttcccaagaggggggtgtggcacaaataaaacccctttgggagaaagcacaaaaat

SEQ ID NO: 87708 - protein, 114 aa, Zea mays
  misc_feature: Ceres CLONE 1574826
MASETETFAFQAEINQLLSLIINTFYSNKEIFLRELISNSSDALDKIRFESLTDKSKLDAQPELFIHLVPDKATNTLSIIDSPTPMTKSDLVNNLGYIARSGTKEFMEAPCCRR

SEQ ID NO: 87709 - DNA, 957 bp, Zea mays
  misc_feature: Ceres CLONE 1574827
  misc_feature: Translation starting site: 106
  misc_feature: SWISSPROT Homolog: EC 3.4.21.25 Cucumisin
tggagctccccgcggtggcggccgctctagaactagtggatcccccgggctgcaggaattcgtctcacccctagaaaaagcaacgcgcacggcacggcgtccgggatggcgccgcacgcgcacctggccatctacaaggtgtgcacgcggagccggtgctccatcatggacatcgttgccggcctggacgccgccgtcaaggacggcgtcgacgtgctctccttctccatcagcgccacggacggcgcgcagttcaactacgacctcatcgccatcgccacgttcaaggccatggagcacgggatcttcgtcagcgccgcggcgggcaacgacggccccgccgcgggctccatcaccaacggcgcgccatggatgctgacggttgcggcgggctccccccaccgcgcgatacgcaccaccgtcaggctcggcgacgggcaggtgttcgacggcgagtcgctgttccagccccggaacaacaccgcggggcgcccgctgccgctcgtcttcccgggccgcaacggcgacccggaggcccgcgactgcagcacgctggtggaggccgaggtgaggggcaaggtggtgcctgtgcgagagccgctcccatcccggagcacgtcgagcaggtgcagatggtgtccgcgtacggcggcgccggcatggatcctcatgaacaagccggcgggagggtttcaaccaccttcgccgacccgcacgtcctgccggcgtcgcacgtgagctacgcccgcggggtccaagatcgcggcgtacatcatgtcaacgcccaggcccacggcgacattaactttctggggcacgggtgatgggctcgttccccggcgccgtccgggtggctttcttctctttcccgcgggccctaaacaaggcgagccccgggcatcctgaaataccggaatctcccggggccgcggatagaaactcctgggcgggcttgtg

SEQ ID NO: 87710 - DNA, 918 bp, Zea mays
  misc_feature: Ceres CLONE 1574830
  misc_feature: Encodes the peptide sequence at SEQ ID NO. 87711
  misc_feature (834)..(834): n is a, c, t, g, unknown, or other
  misc_feature (835)..(835): n is a, c, t, g, unknown, or other
  misc_feature (888)..(888): n is a, c, t, g, unknown, or other
ctggagctccccgcggtggcggccgctctagaactagtggatcccccgggctgcaggaattcgtctcacccctagaaaaaaagaacagcctcaggttactcgcagaaaagatttattagctcgccgcgggggtcgaaccgagactcctagctagctgatcgcgcgcgcacaaggcgagcggacaagaaagcttgctttgtgctcaccggcgggcggcggcacggaccccctgcgatggaagccgtcggcgtcactcctgcccccgtggcggcgccggagaagaagaagctgcttgacctcaaggaccccttccccgccgccgcgaacggcggcaccaaggcgtccccggcgagtaagtgggcgatgaagaagaagctggtgggcggcgacgccggctacgtgctcgaggacgtaccgcacctcacggattacatgccccagctcccgacatacccgaatcctctccaagacaacccggcgtattcagtcgtcaagcagtatttcgtcaacccagacgacaccgtcacgcagaagattgttgttcataagaccagtgccaggggcacccacttccggcgtgccgggccacggcagcgggtgtacttccagtccgatgaggtgaacgccgccattgtcacctgtggaggcctctgcccgggattgaacacggtcatccgcgagcttgtttgcggcttgtatgatatgtatggcgtctccagcgtcgtcggcatagagggtggatacaagggtttctattctaaaaatactgttgcgttgacaccaaagtcggtgaacgacatccataagagaggcgggactgtcctcggaacctcnnagagaggcatgacactgccaaaaatcgtgatttgtctcaggaccgtggcattnacaggtctatattatcgggagcgacggcct

SEQ ID NO: 87711 - protein, 228 aa, Zea mays
  misc_feature: Ceres CLONE 1574830
  misc_feature: SWISSPROT Homolog: EC 2.7.1.11 6-phosphofructokinase
  misc_feature (201)..(201): Xaa is any aa, unknown, or other
  misc_feature (218)..(218): Xaa is any aa, unknown, or other
MEAVGVTPAPVAAPEKKKLLDLKDPFPAAANGGTKASPASKWAMKKKLVGGDAGYVLEDVPHLTDYMPQLPTYPNPLQDNPAYSVVKQYFVNPDDTVTQKIVVHKTSARGTHFRRAGPRQRVYFQSDEVNAAIVTCGGLCPGLNTVIRELVCGLYDMYGVSSVVGIEGGYKGFYSKNTVALTPKSVNDIHKRGGTVLGTSXRGMTLPKIVICLRTVAXTGLYYRERRP

SEQ ID NO: 87712 - DNA, 1026 bp, Zea mays
  misc_feature: Ceres CLONE 1574831
  misc_feature: Encodes the peptide sequence at SEQ ID NO. 87713
  misc_feature (705)..(705): n is a, c, t, g, unknown, or other
  misc_feature (1026)..(1026): n is a, c, t, g, unknown, or other
gcggtggcggccgctctagaactacgtggatcccccgggctgcaggaattcgtctcacccctagaaaaagcagcgccagcgcagcgcctctctgctactgtgctggctgacgcccgtggggtgtgagccaactgcgagctgctgccacccctgctgccgcggtcaagcgccggccccggcaccgagatggacgctcgatgggcgagtgctgctcgcgcttctggacgccagcggcggcgtccgtgtctgtcccgatcttggggtcaagggcgctcactggctgggggggctgaaccacgcatcgttccccaatgggttactgttcaggatggcgacgccggattactcgtccccagggcggcggatggagcaaaggccggggtctttttaatggtgccccttatttggcgccccatcgcaacgcaaaagttgcacgggaatccaaaatgagggacgacgcataaggaattggaaacccttctcttcaaatcgaaaaaaaatccccttcttttttgtagggtgtaaaacctttggaagagctatccggatttcttcgaaagggggtttggaccgctagaaaatatcccaacgggagagttacaaaaagttgttatccttccacacccatcgacagggttgtggaggattgtgtatcctaacctaaacttcggggaaaaaacattaatagcgttaattcagaacccncgggccgttgtagtttcgttttacgtttggcaacccttaaaagcccacccgaataaatcctctcccggcgttggtactatatgtagtacgataatttgtggggaaggaggtaattgcccaccgcgagtcgtatttggagcggaccagtggcgccgttagtgcttttcctggtaagggcgctgggtgtataaagaatgcacacggggcgcctacttttgcgggatgatggtttgatgtcatttttttacggactccggagcggaaaggggaatcctcctcttaggtgtgttggtgcgtcgggtgtaatcacttacctccatn

SEQ ID NO: 87713 - protein, 31 aa, Zea mays
  misc_feature: Ceres CLONE 1574831
MGECCSRFWTPAAASVSVPILGSRALTGWGG

SEQ ID NO: 87714 - DNA, 873 bp, Zea mays
  misc_feature: Ceres CLONE 1574833
  misc_feature: Encodes the peptide sequence at SEQ ID NO. 87715
  misc_feature (793)..(793): n is a, c, t, g, unknown, or other
aaagctggagctccccgcggtggcggccgctctagaactagtggatcccccgggctgcaggaattcgtctcacccctagaaaaactctttccattcctccgcgccgccactagctgtcctaaaccctaccatcacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaaacttacagatgtggcagagtgtttagctgggaggatcatgaacaagagaacatcgtcgtcgaagctattcttttatgatctttatggtggtggcatgaaggttcaagtgatggctgatgccaggacctcggagttggatgaagctgaattttctaagtaccactcaggtgtgaagcgaggtgatnatgttggcatatgtggatatccaggaaaaagcaccgaggggagcttagtgtattcccaaagagattgtcgtcctctctca

SEQ ID NO: 87715 - protein, 217 aa, Zea mays
  misc_feature: Ceres CLONE 1574833
  misc_feature (135)..(216): Pfam Name: tRNA_anti Pfam Description: OB-fold nucleic acid binding domain
  misc_feature: SWISSPROT Homolog: EC 6.1.1.6 Lysine--tRNA ligase
  misc_feature (191)..(191): Xaa is any aa, unknown, or other
MASGLEEKLAGLSTGGDGQNPPPAGEGGEEPQLSKNAKKREEKRKKLEEERRLKEEEKKNKAAAASGKPQKASAADDDDMDPTQYYENRLKALDSLKATGVNPYPHKFPVGISVPEYIEKYRTLSEGEKLTDVAECLAGRIMNKRTSSSKLFFYDLYGGGMKVQVMADARTSELDEAEFSKYHSGVKRGDXVGICGYPGKSTEGSLVYSQRDCRPLS

SEQ ID NO: 87716 - DNA, 905 bp, Zea mays
  misc_feature: Ceres CLONE 1574834
  misc_feature: Encodes the peptide sequence at SEQ ID NO. 87717
  misc_feature (905)..(905): n is a, c, t, g, unknown, or other
tgctggagctccccgcggtggcggccgctctacaactagtggatcccccgggctgcacgaattcgtatcacccctagaaaaaggcccccacccgtgtagctgctcgagaagtagttcaacagtatccggtctcctgctccatcgacgccgtcgagaaggcctgagctcaggccaccctgcgcctccccatgggctgcccgcccatgggtcacgtcctctacaacgacgtcttgcgctactaccccaagaacccctactggttgtaccgcgaccgcttcttcctctgcgccggccacagctggatgctccagtacgccctcttccacgtcagcggttaagacagctatacggaggaggacttgaagcattccaggcaatgatcgaagcagatcaccgggcaaccctgaaaactttgagactcccgcatgttgaaatttccatcctggcctcttggtcaaggtatcgccaatgccgatgggttggcacttgccgagaagcacctggctgcccacttctacgagcatgactgtgagtatcgtcgaccactacacatacgttgcttctgcagatggctgccacatggagggaattgccaatgaaacttgctacttgtccggacactggggtcttggcaagctgtagcgcttgctaccattgacagcgcatttccatcgacggagacacggacattgcattcatcgacgacgtgatcacccgcttcgtcgccctcgccttggagcagatctaggtccactatggctactccggacttgatgacaatccgctcatccattagcgaagccgaacgcgttttaccgactaccgcacctttgatcaaggtgaataccaacatccaggttcggacttccagaaacatggcctactcattcggtgtatcacggtan

SEQ ID NO: 87717 - protein, 49 aa, Zea mays
  misc_feature: Ceres CLONE 1574834
  misc_feature: SWISSPROT Homolog: EC 2.2.1.1 Transketolase
MGCPPMGHVLYNDVLRYYPKNPYWLYRDRFFLCAGHSWMLQYALFHVSG

SEQ ID NO: 87718 - DNA, 950 bp, Zea mays
  misc_feature: Ceres CLONE 1574838
  misc_feature: Encodes the peptide sequence at SEQ ID NO. 87719
ctggagctcaccgcggtggcggccgctctagaatagtggatcccccgggctgcaggaattcgtctcacccctagaaaaaatttccactttcgagcgcagaaacgagagggcaggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggcaacttccttacggaccgcccttcgaccaaggtccacgctgctcctggcggtggctcttccctgggatacctgtttggtggcaactgatgccgctcaccaagctatcaccccccactgtcgccgcatgccttttctgaatcgtgaacagccgttgtcatttcatgtgtacccaaacctcccgtcccgcgtgggcccttaagctgcgtctagatttcagggctaatcgtgtgcctgaaccctcatcataagtcgtctctgtacccagcttctcgtttcgtttgcacccgtgatggtatgggtttggttgttgcccactggacctatctattctttgcatttttccttttgaatgtatccttgcccaaaaaaaaaaaaaaaaaaaaaccccatctccggataaaagataggagtgtctctcctttgccatcctcctctctttcagctaagtccctgccccctctctttttcttacatcaggtcctcgcagccccccccttttttcttgttccttcgaacgt

SEQ ID NO: 87719 - protein, 106 aa, Zea mays; identical to SEQ ID NO: 11138
  misc_feature: Ceres CLONE 1574838

SEQ ID NO: 87720 - DNA, 942 bp, Zea mays
  misc_feature: Ceres CLONE 1574842
  misc_feature: Encodes the peptide sequence at SEQ ID NO. 87721
ctcaccgcggtggcggccgctctagaactagtggatcccccgggctgcaggaattcgtctcacccctagaaaaaacgcacgcaacaagcacacccggttagcgtccactaatccgcgaaagcttgactgctccaccacgggtcaccggacatccggcttcctcgccccgtcccccggacgcaggccgccccttaggctcctttgtcattctaccttcctcttcagcacagtacaagcagctgacaaagttctgacctacaagttccaatgacaatctgcagtagtgaagaaatcattgatgagtttgagttgctaacgcgtgatgctaggcgcgtgcagcaggatacactgagaaagattgttgaacagaatggtgatgccgaatatctgaatccccccaaccttggaaggagaacagactcaaagagctttaaatcgtgcattcctctatgtgtgcatagtgacatagagtcctacatccagaggatagccgatggagatgactcgccggtgctaactgggaagcccatcacttccctctccctaagttctggtaccacgcaggcaaaacccaagtttttgccattatatgatgaattgcttgagagtacattccaaatattccgaacctcatatgcctttacaaatcgtgaatatcctattgtcaatggaaaagccctgcagtatgtttacaggagcaagcaagtctttacccaaaggggcattcttacggcaactgcaacgacaaaccggtgcaggagtcaaccttttcaagaaaacgatgaaggacttcatgcacctagtgctgcaggcccgggataaaaacatcttgtggatctagacctccatcagggcttggaacagccatctattggttgggttaattcatacagaacgaagctcagtgttgtttcccgcgcccttgaggaaaggacaatctcg

SEQ ID NO: 87721 - protein, 184 aa, Zea mays
  misc_feature: Ceres CLONE 1574842
MTICSSEEIIDEFELLTRDARRVQQDTLRKIVEQNGDAEYLNPPNLGRRTDSKSFKSCIPLCVHSDIESYIQRIADGDDSPVLTGKPITSLSLSSGTTQAKPKFLPLYDELLESTFQIFRTSYAFTNREYPIVNGKALQYVYRSKQVFTQRGILTATATTNRCRSQPFQENDEGLHAPSAAGPG

SEQ ID NO: 87722 - DNA, 936 bp, Zea mays
  misc_feature: Ceres CLONE 1574843
tggagctccccgcggtggcggccgctctagaactagtggatcccccgggctgcaggaattcgtctcacccctagaaaaactcctcgcccccccggtccgctcggcgcgtgctgcctgcgcgagcagggacgcacgtcacgccttaaccacgtggggaggcgacgacgccacaccaccctatgctctctgtcctcaccctcaaggtaagattgcatcagcactgaatttggcagcttgaagcgttcatccgagacatggaaaaagtgatctgccgggaatatctccttctatgcaagacattcttttcgaaagaaactcttgattggtgtgtcttagcccgtgagaacacccatatctcctctctggtgaactactcatagtgagctatatgctcctctatgctccacaactagcattgctgatgcgatattttcccgaagttattatattccagtctatggcacatatctacatgtaactcctccaccttggtcttccgttgttttgtgctatcgtatgcgcatgaacttaccttctcatttgcccacttcttacctgcacatcaacttcataaaagtttcttttcacgctgatgatgctcatataatgcgggtatgcaaatctctctgcactttgccacaatacttggcgtgtgaatgaagaaactcaactcgagatcgcaacttgcaatatcctgaatttcactgctcattttctcatcttggcagctgaatatatttgccgatctcagcctacatctgttgctcgcctcatcagttcattattctcggtcgactactgaagcatgatattaatcagctagtactcggaaaaccttgccgttcgcgtcttgtcatattactgttggcttgggtatttcgaaggggatacttggaaaggtcgctttgacatacaacactggaagatcaggtcgat

SEQ ID NO: 87723 - DNA, 854 bp, Zea mays
  misc_feature: Ceres CLONE 1574844
  misc_feature: Translation starting site: 199
  misc_feature: SWISSPROT Homolog: EC 1.4.1.2 Glutamate dehydrogenase
  misc_feature (851)..(851): n is a, c, t, g, unknown, or other
aaaagctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtcttgacaagaaggcaaccagcgtcggtgagaagaatgtcctcatctttgacctttggagtggtaccttcgatgtctccctccttactantga

SEQ ID NO: 87724 - DNA, 893 bp, Zea mays
  misc_feature: Ceres CLONE 1574845
  misc_feature: Encodes the peptide sequence at SEQ ID NO. 87725
tggagctccccgcggtggcggccgctctagaactagtggatcccccgggctgcaggaattcgtctcacccctagaaaaagttctatatcgccccattgctcgctcgctcgccaagagttcttcttgttaggcaaggcaaaagcagaagcaaaaaaagaaaggaaaaagaaaggtcttgttgccgatggggagctcagggttctcgtggacgcttccggaccaccccaagctccccaaggggaaaccggtggctgtcgtcgtgctggacggatggggcgaggcctaccccgatcagtacaactgtatccatgtcgctcagactcctgtcatggactcgctaaagaatggcgctcctgagaaatggagactagtgaaggctcatggaacagctgtgggtctcccatctgatgatgacatgggcaacagtgaagttggtcacaatgcacttggtgctggtcgaattttcgcccaatgtgctaagcttgtcgatcaagctcttgcctccggaaagatttatgatggagatgggttcaactacatcaaagaatcttttgaaagtggtactcttcaccttattgggttgttgagtgatggtggtgtccactcccgtcttgatcaactgcagttacttctgaaaggtgtcagtgagaggggggcgaaaaatatccgtgtgcacatccttaccgatgggcgtgatgttttggatggaagcagtattggtttcgtggagaccctagagaaagatccttttggagcttagaaccaaaagttgttgatgcacagattgcatctggttggtggaaggatgtatgttaccaatggaccgtttttagaaaggactggggatgtggtttaacgtgggttggggattcccaaagtgtctttggaaaaca

SEQ ID NO: 87725 - protein, 191 aa, Zea mays
  misc_feature: Ceres CLONE 1574845
  misc_feature (18)..(190): Pfam Name: iPGM_N Pfam Description: BPG-independent PGAM N-terminus (iPGM_N)
  misc_feature: SWISSPROT Homolog: EC 5.4.2.1 Phosphoglycerate mutase
MGSSGFSWTLPDHPKLPKGKPVAVVVLDGWGEAYPDQYNCIHVAQTPVMDSLKNGAPEKWRLVKAHGTAVGLPSDDDMGNSEVGHNALGAGRIFAQCAKLVDQALASGKIYDGDGFNYIKESFESGTLHLIGLLSDGGVHSRLDQLQLLLKGVSERGAKNIRVHILTDGRDVLDGSSIGFVETLEKDPFGA

SEQ ID NO: 87726 - DNA, 961 bp, Zea mays
  misc_feature: Ceres CLONE 1574846
ctccccgcggtggcggccgctctagaactagtggatcccccgggctgcaggaattcgtctcaccccttagaaaaatccgtctcctctctacctggtaagataggtcgtctactgaacacttgggacgtacccgacaccgcctctctattcgtctgttatttctccccgtgcgctcgacgattccttggtccactcccgcgtggttcggtatctggtcggattctctctcctcagacatgctctccgatcttcctgtgatcaccttgcccgccggcgggtgctgtgggctgcttgctggtcgattcttctcccattcttttggctgctccgcttcctgatacttctctccgcggcgggtccggggcccatccagagtctccctgatgcgcgattctgcctccgagacacgtttgctgggtcctgacaacagagatgccacccccctgctgcgagagcctgctgacgagcctgacgaccttcttatggtcccgcgatacattgatgggagctgcatggcgaagatcgctcctggatgagcgctgaccgacctgatcgaggaggagcatctggctcgtgtcgatgggagtttcggtctgctgagacagattatcctgattggcttgcatcgcctcgtcaatcggcttccgattgcgattataagcttgggacgtgtctccccagggctaagaagcctagacatcttgtggcctgctactcgagcaagcttcattggatatcttgagagctccacgcttgcttccagaggtggctgggctcgtcccccgctcttaccatgctgagctgcccgcgccgtcggagatgcatctcgcgtaaagaataagtgcttaaacaccgtattgatgctggactagctacccacagagtccgatctctgaggggcactgatgaaccgggatactagctgatgcccgcagagctaaaataacctttagatgtcctt

SEQ ID NO: 87727 - DNA, 851 bp, Zea mays
  misc_feature: Ceres CLONE 1574849
  misc_feature: Encodes the peptide sequence at SEQ ID NO. 87728
cggccgctctagaactagtggatcccccgggctgcaggaattcgtctcacccctagaaaaaaccaccagtgtcccgtccccggtttgactgccgagctgattcgtgtgggcgtcaatggtgaacaccgggcgcttcgtcgtcctcgtcctcgcctaccgcctcctggtacccctcctctcaggctcagctgaaccggaccacaccaccaaagagtcgtatgtcgtatacatggggagcccgtcgggcggcggcgacccggaggcggtgcaggcggctcacctgcagatgctgtcgtccatcgtcccgagcgacgagcaggggagggtggcgctgacgcatagctaccaccacgcgttcgagggcttcgccgccgcgcttaccgacaaggaggccgccgcgctctccgggcacgagagggtggtgtccgtgttcaaagaccgagccctgcagctgcacacgacgcggtcgtgggacttcctggaggtgcagtccgggctccagtccggccgcctcggccgacgggcgtcggggggaatcattatgggcatcttctacacgggcgtctggccggagtctccaaacttcaaccaaccccggattccgggacatgcccgcgcggtgggccccgcctgtgcatggaaaggccccactttcaaaaaaaacaactgccaacaagaaactcatgaggggccccgggttttacggggttcaaccccaaattagtgtgggatcgaaagccttcccacaacgcccctgggggaagcctcggcccgcaaaccaaaatttaccccttggaacacccgggggggcccagaggagaggaaaacgccgtttttaccggggggggggg

SEQ ID NO: 87728 - protein, 202 aa, Zea mays
  misc_feature: Ceres CLONE 1574849
  misc_feature (33)..(114): Pfam Name: Subtilisin_N Pfam Description: Subtilisin N-terminal Region
  misc_feature: SWISSPROT Homolog: EC 3.4.21.25 Cucumisin
MVNTGRFVVLVLAYRLLVPLLSGSAEPDHTTKESYVVYMGSPSGGGDPEAVQAAHLQMLSSIVPSDEQGRVALTHSYHHAFEGFAAALTDKEAAALSGHERVVSVFKDRALQLHTTRSWDFLEVQSGLQSGRLGRRASGGIIMGIFYTGVWPESPNFNQPRIPGHARAVGPACAWKGPTFKKNNCQQETHEGPRVLRGSTPN

SEQ ID NO: 87729 - DNA, 939 bp, Zea mays
  misc_feature: Ceres CLONE 1574850
  misc_feature: Encodes the peptide sequence at SEQ ID NO. 87730
  misc_feature (853)..(853): n is a, c, t, g, unknown, or other
  misc_feature (939)..(939): n is a, c, t, g, unknown, or other
cggccgctctagaactagtggatcccccgggctgcaggaattcgtctcacccctagaaaaagcgaacgccacggagccggagcctattcacgacgggtcgaccgggcgagggaccctcgacctgcccgcctcgcttcctccgacgcctaaggttttctaccggacgccgccgccgccgcagcatcggcccgggatgcacgtgtgcccgcgcagttagccgccgtgggaccctgcgccgccgcgcgccatgtcattcttgccgcggcgaaagccgctgccgccctctgacggtgacgagtccgaccacgacgacaacgacgaggggaagaagccgtcctcatcctccgggtcgccgtccaaggagcccacgaagcggaccaacgccagccccgtcgtgcgtgaacagctgctgctggctggtcgggtgcgtgtgctccgcctggtggctgctgctctttctatacaacgcgatgcctgcctcattcccgcagtatgtgaccgaggccatcacggggccgctcccggacgcgctcggggtcaagctgcaaaaagaggggctgcgagtgaagcacctcgtcgtcttcgtcacgggcatcttcaccggggggcctggagttatgggggggggcaccactgccccaagagggctcttccggaagagacctttgggggcggcacctatggttgacgtttacaagataccactttgctcggggcgaaaattagttcattggaaaatgaaaactggtttaaacaaaactggaattaagggttagggcgagttacaaggccctggtagaagcaaaacatttttgtccgctgaatttcttggtttggggctgcttttacttgncaattagagcggtttttggatttaaaaaaatataccccgttcctggggggcaaattattgggcggtttgcttatccagaaacccgn

SEQ ID NO: 87730 - protein, 101 aa, Zea mays
  misc_feature: Ceres CLONE 1574850
MPASFPQYVTEAITGPLPDALGVKLQKEGLRVKHLVVFVTGIFTGGPGVMGGGTTAPRGLFRKRPLGAAPMVDVYKIPLCSGRKLVHWKMKTGLNKTGIKG

SEQ ID NO: 87731 - DNA, 929 bp, Zea mays
  misc_feature: Ceres CLONE 1574851
  misc_feature: Translation starting site: 343
  misc_feature (734)..(734): n is a, c, t, g, unknown, or other
  misc_feature (824)..(824): n is a, c, t, g, unknown, or other
aagctggagctccccgcggtggcggccgctctagaactagtggatcccccgggctgcaggaattcgtctcacccctagaaaaacgagcagcagagtctggccgccttgtcccgacgcgcgatcccatcccttcccatccagcgcggctccaatcctgtcgcggccattaaaagcttccctcccctgcctctctctgctccgctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggaggagttgatgctggaggatggaggcatcgaggagagcccgcgccgcagcttcgaggactgcggtgattccgacgaggaggacgatgacaacgatgaggagcgggacggcgacggcgtcggttcgccgcgctccttccagtcccataagtggccgcagagctacagggaaacaactgatacttacacaatcgctgcatcaccgagctttggttacttgggcccttctacaagcaaatactcactcctcgatcttggtcgtagtggtctgggttctgacctgaagttgcctctagtgtcggacaaggctgacggaaaacaagattctgtcaaaaccctgccgaaaaaccntggttcaataagagatgagagggtctcatttcaattgcacacacgggagaactctacattactcaagggtgcaatgtgacgcaaacagtnctcaatgggaataatgtacttgctggtgttggccttctttccacccgtttacaatcatgaaacctgatggacgggccttgcaattctagtatgttttgcgaatgt

SEQ ID NO: 87732 - DNA, 916 bp, Zea mays
  misc_feature: Ceres CLONE 1574852
  misc_feature: Translation starting site: 164
  misc_feature: SWISSPROT Homolog: EC 1.10.3.2 Laccase
acccgcggtggcggccgctctagaactagtggatcccccgggctgcaggaattcgtctcacccctagaaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccgccagataaggactgtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgaagtggtgggatgcgaacccgatcgacgtcatccgggtagcgcagaggaccggcggcggtcccaacgttctccgacgcgttcaccatcaacggccagcccggcgacctgtacaatgctccaacaaagagacactgccatcccggtgaaggctgcgagacggcgctgctgcggtcatcaacgcgcgctctaccacgagctggtcgtcacatcgcgcagcaaagatgacggtcgtcgccaccggagcgtcct

SEQ ID NO: 87733 - DNA, 864 bp, Zea mays
  misc_feature: Ceres CLONE 1574854
ctggagctccccgcggtggcggccgctctagaatagtggatcccccgggctgcaggaattcgtctcacccctagaaaaagaacactctctctcaccacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgttggctgtgcgactgcgagctagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagccttttctccccggtcgccatcctcgtttattacacacaccctctcttgccgatcactgctcgcttctctgcctgcttctgcttgagtcgtggcagtgacccgtgaccgtgaccgcgagcttcagggacgcgggcggcggcgatcatgtcgtgg

SEQ ID NO: 87734 - DNA, 972 bp, Zea mays
  misc_feature: Ceres CLONE 1574856
  misc_feature (763)..(763): n is a, c, t, g, unknown, or other
  misc_feature (956)..(956): n is a, c, t, g, unknown, or other
  misc_feature (957)..(957): n is a, c, t, g, unknown, or other
ctccccgcggtggcggccgctctagaactagtggatcccccgggctgcaggaattcgtctcacccctagaaaaagctcccctccacatccactgctgtggcgctctccctctcccgtctccccttaccttctccacctcccccattccgccaccgcacaagccgacctccctcaccaagaggagaaaagaaagggagagcgaaggaggcaaaccaggtgggacagcaacgcgacgtgcttgctattctctctagttggatgctgagtggcatgccggtcgatatttgggaaagcagatttttatgttggcaagtgtgagtgcgagttctttgctgaaactttaagcttcacctgagatctgatattgtcggtgccaaattgctgtacatttgactatttgaggacacgttcttaggagctcatgcaggtggtaagtcttactgcaagaagggcagctgtgcatgttaagacccatacatagcttctcttgattacacagcacggggggtgaaaacttgagatacagttgatctcctggttcagagtatgggttcaaggtttgcatcgcatcagctgagcaatggcctgtatgtttctggtcgacctgaacaacctaaggagaaggccccaaccatttgttccactgcgatgccatatactgggggtgacatcaagaaatcaggagagctggggaagatgtttgatctccatgttgagaagcaagaaaatctggtcctctaggaaatgctccttcaaggatacntcatttggaggtgctgcttccaactctggacccgtatccaatgctgggcggtcggtcaattactctgggtctccttcatcctcagttcctgggtgctggcggatcagccagagcaaaatcaaactctggaccgctccaatagcatggagaagcccacaagagtcatctggtccccacatctggaggattgacnnccatggcacgccaga

SEQ ID NO: 87735 - DNA, 917 bp, Zea mays
  misc_feature: Ceres CLONE 1574858
  misc_feature: Encodes the peptide sequence at SEQ ID NO. 87736
  misc_feature (453)..(453): n is a, c, t, g, unknown, or other
gcggtggcggccgctctagaactagtggatcccccgggctgcaggaattcgtctcacccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaagatgatgatgaccntgatctttttggtgatgaaactgaggaggacaagaaggcagctgatgagcgtgctgccgctgcccaaggcctctctaaaaagaaagaaaggggtaaatccctccgcccttatgatgtaaacccttgggacgatgagactgatttgaaaaagcctgggaggaggcttgtccccatgttccaaatggaagggctgacttggggagcatcaaaactttgggccggtggaaaccgggtcaaaaaaatgacctccttggtggaaattgggcaacatatttgtggcccccggacctcttattggggggcccctttccccaaaaccccttcaagggaatccctccaaaagttgcaaaatttgggggctttcaaacaaaaccaaagagttctttttccggagttgggggaaagggagagggccccaccctgccacaatttgtgggggggaagccacttttccccccctcgga

SEQ ID NO: 87736 - protein, 252 aa, Zea mays
  misc_feature: Ceres CLONE 1574858
  misc_feature (98)..(98): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDDXDLFGDETEEDKKAADERAAAAQGLSKKKERGKSLRPYDVNPWDDETDLKKPGRRLVPMFQMEGLTWGASKLWAGGNRVKKMTSLVEIGQHICGPRTSYWGAPFPKTPSRESLQKLQNLGAFKQNQRVLFPELGERERAPPCHNLWGGSHFSPPR

SEQ ID NO: 87737 - DNA, 856 bp, Zea mays
  misc_feature: Ceres CLONE 1574859
  misc_feature: Encodes the peptide sequence at SEQ ID NO. 87738
  misc_feature (799)..(799): n is a, c, t, g, unknown, or other
  misc_feature (809)..(809): n is a, c, t, g, unknown, or other
  misc_feature (810)..(810): n is a, c, t, g, unknown, or other
ctggagctccccgcggtggcggccgctctagaactagtggatcccccgggctgcaggaattcgtctcacccctagaaaaactccgcaagaatccagcgagccaacaaggcaacaacaaacacctccctccttcttcacttccctgccgttgttgcaggaagcaagcgagggcacacaaaccgacaaggccgcccacgcgcgcgtcggccgccgccgttgccgaccagcaggcaggcagcatggtcgtgaacaacaaggtggacagcctgtcgtacgacgtcgaggcgccgccgccctctgccgccggcgccgccgcggggcaagcgccaccgccggcgtcgccagctccggcgccggcaccggcaacccacgcgcccgtgacgcgggaaggcggcgcggcgtcggtgctggagctgcacaaggtgtcgctgccggagcggcggacgacggcgaaggcgctgcggcagcgcctggccgaggtgttcttcccggacgacccgctgcaccagttcaagaaccagtcgtcggcgcggcgcctcgtgctggcgctgcactacttcttccccatcttccagtgggggtccgcctacagcccgcgcctcctgcgctccgacctcgtcgccggcctcaccattgccagcctcgccatcccgcagggaatcagctacgccaagctcgccaacctgccgccaatcgttggcctatattccagcttcgtgccgccgctcatctacgcgctgctggggagctcgcgggaactggcggtgggggcggtgtcatcgcgtcgctggtgatgggntccatgctcnngggacgccgtgtcgccggacgagcagccgctcctctacctgcagct

SEQ ID NO: 87738 - protein, 184 aa, Zea mays
  misc_feature: Ceres CLONE 1574859
MVVNNKVDSLSYDVEAPPPSAAGAAAGQAPPPASPAPAPAPATHAPVTREGGAASVLELHKVSLPERRTTAKALRQRLAEVFFPDDPLHQFKNQSSARRLVLALHYFFPIFQWGSAYSPRLLRSDLVAGLTIASLAIPQGISYAKLANLPPIVGLYSSFVPPLIYALLGSSRELAVGAVSSRRW

SEQ ID NO: 87739 - DNA, 862 bp, Zea mays
  misc_feature: Ceres CLONE 1574866
ctggagctccccgcggtggcggccgctctagaactagtggatcccccgggctgcaggaattcgtctcacccctagaaaaaaaaaaacctacggggtactgctacctcaacgagcatatctgctttttttgtggtaaaagaatttgtattatgcaagctaggtcctaaggtgtcgccgtcatgcaccgcttcgccgccgatagggtgcgccgcgcggtggccgcgtgcctgcgcggcgcagattccagagcagcagcagcgccgacacgtcacgctccggagccactccatacaaactcacccagtcagggcggcggctcctgttgctgccaccgccatggggagggccggcatgttgcacggcgagtgcgggcgtgccaccacgggtgatctgtcgacacaattagcctgaaagagccggtggtgtcgctgcaagcaatgatcatcaagggatcgacaggtccagtgccagtgtggggagagattgtcacacatgctcacaaattgtatgagatctgcagagaaatccagaatcttatccttttgatgagatactctactgacactttggaaattgatattggattgcaacaccgttagtggacggattccgacaaagtctgtaaatctgtgaggattgacatctcttggacttggaagaactcatgctatgtgccagtaccatgctctctagagagactgtataatctccgacatcatgctctgagacctactgtatcatcggacatatccaaggtataaaatgatatcgtgaggcaattgctgacatgaatgctgcccgtgatagtgtaagatgtggagtcccatacatcttactaacggatggcgcatacactatgcag

SEQ ID NO: 87740 - DNA, 1259 bp, Zea mays
  misc_feature: Ceres CLONE 1574868
tttttgcgtttcccttcacttatatttcaacatacacaccaccagtatgggtttttttgttttttttctatagctggagctccccgcggtggcggccgctctagaactagtggatcccccgggctgcaggaattcgtctcacccctagaaaaaacttccccgagacgacggcgaaacaaggggtaaaaaaaggaaaggggatcgccatggcagcgtcgccgcagcagcaaggccagggcggccctggcagcggcgggtggactcccgagcagttctggtcgctgctggacaaggcggaccgccggttctcccgggtgcgagatctgccctccttcggccgccaggagcccgacgagttcgccaaggccttccgcgcctacacccagctctggcggatgcagcaggagcaccgtcaccgccttctctacgcgggcctccgccgctggcaggtcggcgagatcgccgcccgcaccccccacctctactacgcccagtaccagcgcaccgccgacaccgcgcttctctccgaggcgtttcgtcttctaacaacgccgtcctcgaccggtgccttaccttccagtgacgccgaaccacctccttcatcccccgtccaagccaccttccggctttcctccgccagggtttccctccctcgttctacacttcccttgcttccgggaagggcggttacgccaacacccggttccccttgtttcctcgacccctccggtaaaactaaccgccacgggcttcctttaaaaatacaacctctccaaaaaaaaagttctcctttctcaagaggaatagtccccgtaaattacccacataggtaatcctgggataatgggccctatgtgtttctatctgccaaaaggaaaatatatccgccgaccagggggtttctcccttgggccgagacacctgtaaacgtctaactccagtcgcaagtggtacaactcttgacaggcgcgctctctccacagggtaaacagctctttattattcacattttccatattctctcccccccacctggtaataacacgcctttcgtatgatccaatgtgccacaactctaacttatccaaaaaaaatccgaagagaactcccgttcccttattcgtgaaaacaccatatcgctgtttgcaagcatacctatatcctatacactaggttcgaaaatatttgagacatctcctccacatagattgttatctccaatatgctctacttggcccctctatagcgaatacccgtgt

SEQ ID NO: 87741 - DNA, 874 bp, Zea mays
  misc_feature: Ceres CLONE 1574874
  misc_feature: Encodes the peptide sequence at SEQ ID NO. 87742
  misc_feature (550)..(550): n is a, c, t, g, unknown, or other
  misc_feature (825)..(825): n is a, c, t, g, unknown, or other
  misc_feature (826)..(826): n is a, c, t, g, unknown, or other
ctggagctcaccgcggtggcggccgctctagaactagtggatcccccgggctgcaggaattcgtctcacccctagaaaaagatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactacggggtcgtcggcatcggcacgccgccgcagaacttcaccgtcatcttcgacaccggcagctccatacctctgggtcccctccctccagatgctacttcctcggattggcctgctaccttggcccccccngattaaaaagtgggccaatttttcacgttaaagggggaaaggggaaaaccgaaaaaaacccttggtccccgcggcatataccgggggtttttaaaaaaaaaaacaaactggtgtggggaacctcccccccaaaaaaaaaaaaatttttttgaaaaaccccgaaaaaaagcgaaacctcttaataagggggattttggggggggcccccccgcgggaaataacacaaaaaaaatctcccggagggggcgccccccccccttctttaaaaaaaaaannaaaaaaaaccccccccggggaggaaaaaaatcccccttcttttttttt

SEQ ID NO: 87742 - protein, 134 aa, Zea mays
  misc_feature: Ceres CLONE 1574874
  misc_feature: SWISSPROT Homolog: EC 3.4.23.1 Pepsin A
MGRGRGHLLLPAAAACLWALSCALLLRASPHRAGAGAGGLLRVGLSRRGGGLDQRALAAAKAARQQEASRLGASGGGDVPLVDYLNTQYYGVVGIGTPPQNFTVIFDTGSSIPLGPLPPDATSSDWPATLAPPD

SEQ ID NO: 87743 - DNA, 969 bp, Zea mays
  misc_feature: Ceres CLONE 1574876
  misc_feature (811)..(811): n is a, c, t, g, unknown, or other
  misc_feature (869)..(869): n is a, c, t, g, unknown, or other
gctggagctccccgcggtggcggccgctctagaactagtggatcccccgggctgcaggaattcgtctcacccctctggagaacctcgcctcccacctcgccgacccgtggcacaacaacatcggcgacatcatgctccccagatcactctcccattgagctccgctaccccgctggttgctgtttcctgtgtacgactatggcctcgccctgctccaaggagccacgacggcgcacttcctctccctgaaattcaacccctcctcttgcaaagcttgtgctaccaagcagggcccactctcgtgctcttgtctgtatcacacataaactgcttcggtaactgaatcccgaagctagccccgacccgaaccgcgggaaatccacctctgagcgagagaaaatcacatacgaggaccgtcgataagcgtcacacatatgggccacttgttctccctgcctctctgcctgaccaagctcacatcacctgaagcaccattggcgatggcatcctccagcgcgctgaggagctgcaacgccatgcgcctgcccaaccagctagctccaatctgcccggtccggccgcctggcgccgttctgcaacaacgacaccacctctggccgcgtgtcagactccgcggattggatgcccggtctgcctcgacctgaacacatctgctgatcctctcccgggggacttgaggttcgatccactggcctcgcgaccgtgccctagaacttggagaacttctaggagtcctaggcgtaccaccgcgcctgggccttgcctgccgttcaactggatgctgatgccngttcctctgggcatgggccaatgggatgaagctcaagattgcgcagccgtgcactganggcgtgcactttactgagcacccacagagtcgatgtaatgcatgccatcacttctgggaaccgagatggtgccatcttcttctacgagcagcattaatct

SEQ ID NO: 87744 - DNA, 848 bp, Zea mays
  misc_feature: Ceres CLONE 1574879
  misc_feature: Translation starting site: 166
  misc_feature (560)..(560): n is a, c, t, g, unknown, or other
  misc_feature (722)..(722): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
tggagctccccgcggtggcggccgctctagaatagtggatcccccgggctgcaggaattcgtctcacccctaaaaaaaagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgcgggcgcggcggtccgtggcggcgcgcgcggagctgacccgtcgctggtgatcagcctgacacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcgggcctgctcaagtccaacgaccccgtggggctcaacctcgtcgacgtcctcgcctggggctcgctcggccacatcgtcgcctactacatcctcgccaccntcagcaatggatacgaaccccactttcttctgaagcggccggctgcgggcatgttcctgagcctgccctgaattctactccgggtgtggtgaaggcctttttctgaagcccaaggatttttttaatttgaacaaggggggaaactggccgggttaaaaaaanaaaatnnnnnaaaattaataaaaattctccggggctcttccctccccccggaaatgccgggggccgggggttttttaaaattttataagggggggaccccccccccctggttttttggggggggcc

SEQ ID NO: 87745 - DNA, 887 bp, Zea mays
  misc_feature: Ceres CLONE 1574881
  misc_feature: Encodes the peptide sequence at SEQ ID NO. 87746
aaagctggagctcaccgcggtggcggccgctctagaactagtggatcccccgggctgcaggaattcgtctcacccctagaaaaatcaccaaaaccacccagaagcctccgcttgaccgcttcactcgctttccgcccgccgcgccatgagcgccgccgcctgcctgttcgctgccgccgtctccctatcattcccgtcgacctccgcaccctcttccgcaagacgccgccgcctccggagccccaccaccctcctccgctgctccccgactcgccgccgtgggccggtccggcggacactcgacgagcggctgctcgaggccgcgccggcggagaccgaagacgtccaaaccgctgttgatgtagaggatggaggagggatcgctgagggcgatgaccccccaacagaggagatggaggagctggagcagcgaccgccgacgagggctttcgtgaagagcaggcggcagcggcaggaagaggaggaagccgcggcggggcaagaccggttcaagctcatcaatggcaaagagatatttcaagagaaggcttatctggttggtgttgagtgcaaacggacaggagggaacctgttcggcatagaggagtccccttaaggagctggagcagttggctgatacggcgggccttctgggagtcggctcaacctatcagaagctttctaccccaaatccaaggactttacattggttcaaggaaaggtttcctgaaatcaggactgcaatccaagcactttgatgttgagactgtaatttttagacgatgaagttatccccctgggacaactacgttaacttgggaaaaggcatttgggtgggaagtggctcccaatcctgtgatccaaactgcctccttattctttgaaaa

SEQ ID NO: 87746 - protein, 156 aa, Zea mays
  misc_feature: Ceres CLONE 1574881
MSAAACLFAAAVSLSFPSTSAPSSARRRRLRSPTTLLRCSPTRRRGPVRRTLDERLLEAAPAETEDVQTAVDVEDGGGIAEGDDPPTEEMEELEQRPPTRAFVKSRRQRQEEEEAAAGQDRFKLINGKEIFQEKAYLVGVECKRTGGNLFGIEESP

SEQ ID NO: 87747 - DNA, 947 bp, Zea mays
  misc_feature: Ceres CLONE 1574882
  misc_feature: Translation starting site: 401
  misc_feature: SWISSPROT Homolog: EC 1.15.1.1 Superoxide dismutase
  misc_feature (630)..(630): n is a, c, t, g, unknown, or other
  misc_feature (724)..(724): n is a, c, t, g, unknown, or other
ctggagctccccgcggtggcggccgctctagaactagtggatcccccgggctgcaggaattcgtctcacccctagaaaaaggtttggccagcctccttccgcggggtggatttggatagcgcggcgcagagaaaaatggcggcttcggctctccacctccaccgccggcgggtgtgaagcttcagcagaggcagctgcgctcgcggcagggtggcctatctcgaagacttttgaaagttgtgtcctattacagtctcacaactccaccatataaactggttgtaagcttgttgacgtcaatctcaaaagattcacgtgctgtcattaaaggaatatccaaattttaactttgtttacctttgttttctggtacaatgctcaggatgctctggaaccttacatgagcaagaggacagttgaacttcactggggtaagcaccatcaagattacgtggatggcttgaataagcagctggctaccagccctctgtatggatatacgctggaggatctgataaaagaagcctacaacaatggcaatccattaccagaatataacaatgcagcacaggtctggaaccatcacttcttctgggaatcgatgcaaccagaaggtggtggcttacctgnagggaggtgtgctgcagcagattgaaaaggattttggctcgtttactaattttagggaagagtttatccgctcagccttacaactattggggtnctggttgggtttggcttgtcttgaagagaaatgagacaaagctttcagtggttcatacacaaaatgctatcttcccacttgcttttggtgatacccaatcatcaacctagacttatggtaggtaaggacatggattcctgagtgtagattctttttttgtgcaaatgttacacttcttttctctcagcatgctactactagactacaagatgatagggctaca

SEQ ID NO: 87748 - DNA, 883 bp, Zea mays
  misc_feature: Ceres CLONE 1574885
  misc_feature: Encodes the peptide sequence at SEQ ID NO. 87749
  misc_feature (401)..(401): n is a, c, t, g, unknown, or other
  misc_feature (883)..(883): n is a, c, t, g, unknown, or other
ctcaccgcggtggcggccgctctagaactagtggatcccccgggctgcaggaattcgtctcacccctagaaaaagttgtcctcctccgcttccctccaaatccaccctggatccaaccccgattttccccagcagaagcaaacccgagcaaattgagcgcttgcagcttcacccggcgaagcagaatcgaatcggagccgctcgccactccgcgatggggatcctcctccggtccctcctcgtcgcctcgctcgtcctcagttcgctcgtcttgcacgtcgcagcggctaaaactatagatccttacaaggttctaggagttgacaagaatgctagccaacgggatattcagaaagcctttcacaaactttctctaaaataccaccctgacggggcgacanccaagggcgcacaggaaaaatttgaagaaataaacaatgcatatgagattctatctgatgaagagaagaggaaaaactatgacctctacggggatgagaagggtaaccctgaatttggtggtggaaattttggaaatcaggggggttctacatacttcactggtggtggccctaaatccagtcaattcacatcgggtaatgaatggcagacaatgggtgggccagggaaaacaaaaaacgttttcacttttccttttgggggtaaacccgggggccagtggcggaaaccccctttgggtggggggttttggattttggggggaggtattccccgaaacacttattgggtgggggcaacaacggggggtgatagcccttatttgggcgccgacaaagtggcgctctatctggggcccaaaactgggtgaatattttggggccaggcatatagtggcgggtctcctcaatacggggagggaatn

SEQ ID NO: 87749 - protein, 204 aa, Zea mays
  misc_feature: Ceres CLONE 1574885
  misc_feature (29)..(90): Pfam Name: DnaJ Pfam Description: DnaJ domain
  misc_feature (63)..(63): Xaa is any aa, unknown, or other
MGILLRSLLVASLVLSSLVLHVAAAKTIDPYKVLGVDKNASQRDIQKAFHKLSLKYHPDGATXKGAQEKFEEINNAYEILSDEEKRKNYDLYGDEKGNPEFGGGNFGNQGGSTYFTGGGPKSSQFTSGNEWQTMGGPGKTKNVFTFPFGGKPGGQWRKPPLGGGFWILGGGIPRNTYWVGATTGGDSPYLGADKVALYLGPKTG

SEQ ID NO: 87750 - DNA, 821 bp, Zea mays
  misc_feature: Ceres CLONE 1574886
  misc_feature: Encodes the peptide sequence at SEQ ID NO. 87751
  misc_feature (399)..(399): n is a, c, t, g, unknown, or other
  misc_feature (556)..(556): n is a, c, t, g, unknown, or other
  misc_feature (561)..(561): n is a, c, t, g, unknown, or other
agctccccgcggtggcggccgctctagaactagtggatcccccgggctgcaggaattcgtctcacccctagaaaaaaaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttccctcgcttcgcgcttaccgcgtccctcgaagcctacggacgcctcactgcccctggntgcccaaggaaaaatgatacctgaaatggatggttgattgctgcaacttccagcaaactaaaattttcaatccaaacctggggcccccccgggaaaattgaaaaaaatatggggtaccttggcccggaacggggtttttccccttttttggggtccnttttnagaaaaaatttttttttggggggcctagggggggggcccccaagtggggggacctctttcccccccccgtaaaatattttataccccgggaaaacgggggttggtttttgtgggcccaaaaaaagggggcccctctttaaaccccttggggggggggggggagcgctcccaccaacccccccgggggaaaaaaccggggggggaaatttttctgtcctcccccacaaaaaaaaagagaaaaccctctcccccccccgccg

SEQ ID NO: 87751 - protein, 99 aa, Zea mays
  misc_feature: Ceres CLONE 1574886
MTEDVQMNDSEPQPAASAPAVGAPALSTLHHLKEIASVIEAGSLSKEVRRISRAFRLTVALRRRLAARDVSAFPRFALTASLEAYGRLTAPGCPRKNDT

SEQ ID NO: 87752 - DNA, 866 bp, Zea mays
  misc_feature: Ceres CLONE 1574889
  misc_feature: Encodes the peptide sequence at SEQ ID NO. 87753
  misc_feature (798)..(798): n is a, c, t, g, unknown, or other
  misc_feature (811)..(811): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
aaagctggagctcaccgcggtggcggccgctctagaactagtggatcccccgggctgcaggaattcgtctcacccctagaaaaacactggacgtgcgctccctccacgctccggcccttctcgcctctccggccatggccaccgccgccgccgccgtcacggccaccttccgcaccctgatccagcacgcagcggcttgtggcgcccccgtcccgctccccagcgtccggttccagagcctgcagcgccaccgcgtcggcctccgccgcttcgcgccaccgcgtgggcgccccgtcctacccccgcccttcgccgccgaggacttctcttcctacgtagatgatttctccggggacgacggcgaggagcacttcgatgaggaagagggctctgagccggaggaggaagccgaggccccgcgcgcgtactcgtcgccacgaagccgcccgccgcgcggcgacgaccccggccgtctcttcgtcggcaaccttccctacacctatacctccgaggagctcgcccaggtgttctctgaggccggcagggtcgacgacgcgcagataatctacgacaaggtcaccaacaggagccggggcttcgccttcgtcaccatggccaccgccgaggaggccgccaaggccatccagatgttcgatggcgccctgctgggagggaggacggctagggtgaactacccggaggtgccgcgtggcggggagaggagaacagtcaccatgagtggccgcagcgtgagatggacttacagatatgcgcactggggtggggagggtgcgaccnttgagacgtgtcnaggtagcgtgtcacagatacggccagtgtctacaacgctgtagaatcgagnnnnn

SEQ ID NO: 87753 - protein, 239 aa, Zea mays
  misc_feature: Ceres CLONE 1574889
  misc_feature (114)..(185): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (222)..(222): Xaa is any aa, unknown, or other
  misc_feature (226)..(226): Xaa is any aa, unknown, or other
MATAAAAVTATFRTLIQHAAACGAPVPLPSVRFQSLQRHRVGLRRFAPPRGRPVLPPPFAAEDFSSYVDDFSGDDGEEHFDEEEGSEPEEEAEAPRAYSSPRSRPPRGDDPGRLFVGNLPYTYTSEELAQVFSEAGRVDDAQIIYDKVTNRSRGFAFVTMATAEEAAKAIQMFDGALLGGRTARVNYPEVPRGGERRTVTMSGRSVRWTYRYAHWGGEGATXETCXGSVSQIRPVSTTL

SEQ ID NO: 87754 - DNA, 997 bp, Zea mays
  misc_feature: Ceres CLONE 1574890
  misc_feature: Encodes the peptide sequence at SEQ ID NO. 87755
ctggagctccccgcggtggcggccgctctagaactagtggatcccccgggctgcaggaattcgtctcacccctagaaaaaatttgttccgtcgcttcaacggcacggaagagaatcgctacccagccaatcgaagtcttctcttgccctgctttatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggccgcggggccgttaacgaccacttcccgggggccagcgacccgctgctccccacgaaacgggatggggacggggacgaggacgacgcatgtgccctcgcgttccacgatttcgacggcgcctccctcgcccggggcggtgttcaacctctccccaccattgttcggggcgggcattcttggcgccttccgggccccatgaagggggctccgggcccgtcccctgggcctcgtcatgaaaagggtttgccggagttctttaccgaaaccctccatcgtgggctgctttgggcggtttaccccggggcccggggggccccctcccttaaaggggggcccatgggccaaacccttctataaggggggggtataaaggcggcccccaggttttcgtgcgctattaaaaacaatgggcgcctagaattgggtacaggaaattctatggggcaggcccttttggaacccccttttgggggggaacccaccttggtgttttagaaaagaggttttaaaaaaccagggggaaaggggcttttatgttttttcttcccccccccttggggttcctcccccatttgtggaaggggtttctccccccctcg

SEQ ID NO: 87755 - protein, 120 aa, Zea mays
  misc_feature: Ceres CLONE 1574890
MGRGAVNDHFPGASDPLLPTKRDGDGDEDDACALAFHDFDGASLARGGVQPLPTIVRGGHSWRLPGPMKGAPGPSPGPRHEKGLPEFFTETLHRGLLWAVYPGARGAPSLKGGPMGQTLL

SEQ ID NO: 87756 - DNA, 840 bp, Zea mays
  misc_feature: Ceres CLONE 1574898
  misc_feature: Encodes the peptide sequence at SEQ ID NO. 87757
  misc_feature (765)..(765): n is a, c, t, g, unknown, or other
ctggagctccccgcggtggcggccgctctagaactagtggatcccccgggctgcaggaattcgtctcacccctagaaaaggcgagtaggcagtaggcacggccggggacggctcctccttgcccaccgcggcgtgcgcggaccgtgcgtccgtgccctccggctccggcgcaccgctccgctcattccatctccatccaccgcgccccaaatcgcacggccccgcctccccattcgcgccgatcgaatcccaatcggcggccatgagcgtggtcggcttcgacgtcggcaacgacaccctggtggcggcggcggcgcggcagcggggcattgatgtgctcctcaacgccgagtccaagcgcgagtcacccgccgccgtcgccttctcccacaacgcgcgcctcatcggctgccacgccgcgtccgcctcgtccgcccacgcccccttctccagcgtcaaacgcctcctcctgggcgccacggggaggaacccggactcctccctcctccgcgacctcccccgcctccctttctccgtctcccacgcctccggtggcggcgccgtcgtccacgttgaccacatcggccgccgcatcgcgctctctccgacccatctcctctccatgctgctcgcctacctcaagcagctcgcggaggccgacctcggaggcgcccccgtcgccgactgcgtgatctccgtgccctgctacttcactcaagcgcaacgccgcgcctacctcgacgccgccgccgtcgcggggctcanggcgctccgcctcatgcacgacctcgccgccgccgcgcttggctacggcctctaccgctccgacctcggcggcga

SEQ ID NO: 87757 - protein, 192 aa, Zea mays
  misc_feature: Ceres CLONE 1574898
  misc_feature (168)..(168): Xaa is any aa, unknown, or other
MSVVGFDVGNDTLVAAAARQRGIDVLLNAESKRESPAAVAFSHNARLIGCHAASASSAHAPFSSVKRLLLGATGRNPDSSLLRDLPRLPFSVSHASGGGAVVHVDHIGRRIALSPTHLLSMLLAYLKQLAEADLGGAPVADCVISVPCYFTQAQRRAYLDAAAVAGLXALRLMHDLAAAALGYGLYRSDLGG

SEQ ID NO: 87758 - DNA, 855 bp, Zea mays
  misc_feature: Ceres CLONE 1574900
  misc_feature: Encodes the peptide sequence at SEQ ID NO. 87759
  misc_feature (855)..(855): n is a, c, t, g, unknown, or other
aaagctggagctccccgcggtggcggccgctctagaactagtggatcccccgggctgcaggaattcgtctcacccctagaaaaaatagtctctaccgcatccttccacaaaaccctttcttccttccgccgccgccgcgaccggctaaacccttcatttcgccgcagcgacgaccacccgccgcgggccaactatggcgcccgttgcggctcccatacgcgacctgcttacctctttcagccccggcgcggacttcctcgcgctctcttctggggacggccgcatcaaggtatgggacgccgtgcggggccggctgcagaccgagtttgctgacatccctgcagtggaggcggtcgcggtcgctgagtcgaagcgcggccacctcgccctcgattacacctgcatgaagtgggtacaactttccagtaagaagaagaggaaggctgggagctcattgattgtgcttggtacaggcagtggagatgtgcttgcacttgatgttgccgcgggacattggaagtggaaggtcagcgattgccaccctgggggtgtgacagctgtagaatactcgaaacatgggcggaatgtgtacacggcaggtgctgatggcatggtctgtaggattgatgcctctaatggggctgttgttggaaaatttaaatcttcttcaaaggcaatatctgcattagctgtgtcatcagatggaaatatgttggcaacagcagctggccagttgaggacctttgacacttccagcaacaaaaaaattaaaaaattctctggacatccagttgctgtgaggagcatggtctttagcaatgatagccaatatgttttggtcatctggagttggtn

SEQ ID NO: 87759 - protein, 220 aa, Zea mays
  misc_feature: Ceres CLONE 1574900
MAPVAAPIRDLLTSFSPGADFLALSSGDGRIKVWDAVRGRLQTEFADIPAVEAVAVAESKRGHLALDYTCMKWVQLSSKKKRKAGSSLIVLGTGSGDVLALDVAAGHWKWKVSDCHPGGVTAVEYSKHGRNVYTAGADGMVCRIDASNGAVVGKFKSSSKAISALAVSSDGNMLATAAGQLRTFDTSSNKKIKKFSGHPVAVRSMVFSNDSQYVLVIWSW

SEQ ID NO: 87760 - DNA, 953 bp, Zea mays
  misc_feature: Ceres CLONE 1574901
  misc_feature: Encodes the peptide sequence at SEQ ID NO. 87761
  misc_feature (549)..(549): n is a, c, t, g, unknown, or other
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcatgccgcggccgacgacggggagctcgccgcgcggtggcgggaggtccacggcagcaacaactgggaaggtctgctggaccccatcgacggcgtgctccntcaggagctcatccgctacggcgagttcgccccagccacctacgacagctttcgataacgaccgcttctccccctactgcgggagctgcaagtacccgggggaggacctttttcacgaagtcggcctcggcgggatcgggtaaggaggtcacccgctacttttagccacctggaaaagacttaaggttcccaaatttgggatttaaaagggccccaaccccaaatttggaggaggcccggcactttttcggggaactgggccggttcacccaaaaaaaaaagggccggcttcgcccccggaaaatccctgggggggggcgggcacccccccccccctaggggggggcgaattttagggaaaaaaattcccgcgggaagaaaggggccccccccgggaccaacag

SEQ ID NO: 87761 - protein, 119 aa, Zea mays
  misc_feature: Ceres CLONE 1574901
  misc_feature (101)..(101): Xaa is any aa, unknown, or other
MAATVSSCLSLVPTVHHRAGGFPSSVALTNTLQRRRRSRRYLVVASATRAEQEAAPVTIEDVDLSSHHAAADDGELAARWREVHGSNNWEGLLDPIDGVLXQELIRYGEFAPATYDSFR

SEQ ID NO: 87762 - DNA, 1028 bp, Zea mays
  misc_feature: Ceres CLONE 1574903
  misc_feature: Encodes the peptide sequence at SEQ ID NO. 87763
ggagctccccgcggtggcggccgctctagaactagtggatcccccgggctgcaggaattcgtctcacccctagaaaaaactccgtcttgctcaacaccagtcaccactgctctccaagcctccaccagcgtccagccgaaccatcgccaccgcaggatggcctcccgcctcctcctccacctccacctgcgccgccgcgggcgcgggatcccgggctgccccgtgcccgcgctacccctccacgccgcgcggctcctctcctcctccccaccaaccgcagctgcggcctcgtcgtcggcggcgggcggcgggggcatctagaaggtgctggtggcgaaccggggcgagatcgcgtgccgggtcatgcgcaacgcgcgccgcctcggggtcgccaccatggccgtgtacagcgacgccgtacgcggggcgctgcacgtgcgcaccgccgacgaggacgtcaggatcggcccgccgcccgcgcgggagagctagctcaacgccagggccatcatcgaagccgcccctccgaacggcgcccaggctatccacccgggataacgtttcccttcccaaaaggggctgaattccccccacctctttgaaacccaaggggctcaaatttcatggggaccccccagcatctggcaattccgaaaaaatgggggccaataaagagtgcgcttccaagaaggaatctcagggtgtgcttgccggggcttcccccccttggttttccgggtgtcccctggggggtgtaaacacaaaaaccttggaaccccttttgaaactccccaaagggagaaaaaaaccggggtatacccgggttttaaaacaaaacccccccccttgggtgggaggggggccaagggggttaaaaaaatttccaaaagggccccaataatattggggaatcctggaccagaggcctcccactggagaagcgcggccctcgtttggggggaaaacacccttggttggaggaagataatacccgcccgaaacactggttaatcctcgattttgcgcac

SEQ ID NO: 87763 - protein, 42 aa, Zea mays
  misc_feature: Ceres CLONE 1574903
  misc_feature: SWISSPROT Homolog: EC 6.4.1.4 Methylcrotonoyl-CoA carboxylase
MRNARRLGVATMAVYSDAVRGALHVRTADEDVRIGPPPARES

SEQ ID NO: 87764 - DNA, 888 bp, Zea mays
  misc_feature: Ceres CLONE 1574905
  misc_feature: Encodes the peptide sequence at SEQ ID NO. 87765
  misc_feature (603)..(603): n is a, c, t, g, unknown, or other
  misc_feature (751)..(751): n is a, c, t, g, unknown, or other
  misc_feature (755)..(755): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaaggggcagcatccggctgcagctcatcaaccagcgctccgacttctccttcgccctcttcaccggncggcctcagcaacccgaagctgattcgcgtgtccgaagccatatcgttcaagaacccaaggcgccggtggtcccgcgcctggcgcaggcacgtccccgacaagattgacgtgacctggacaacggctacccatcgatgaggcgtcccnttcntggatgggccctgcccccnnnnnnnnggnggggggggggggcccccgaaaacccgggggccgccccggggaacttcccttaaacccgggaaaattggggggaaccggccccccctcgggtggagggaccccgg

SEQ ID NO: 87765 - protein, 157 aa, Zea mays
  misc_feature: Ceres CLONE 1574905
  misc_feature (151)..(151): Xaa is any aa, unknown, or other
MAVALLAALVASAAMFMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGQHPAAAHQPALRLLLRPLHRXASATRS

SEQ ID NO: 87766 - DNA, 1060 bp, Zea mays
  misc_feature: Ceres CLONE 1574907
  misc_feature: Encodes the peptide sequence at SEQ ID NO. 87767
  misc_feature (516)..(516): n is a, c, t, g, unknown, or other
  misc_feature (850)..(850): n is a, c, t, g, unknown, or other
  misc_feature (853)..(853): n is a, c, t, g, unknown, or other
  misc_feature (858)..(858): n is a, c, t, g, unknown, or other
  misc_feature (861)..(861): n is a, c, t, g, unknown, or other
ctggagctccccgcggtggcggccgctctagaactagtggatcccccgggctgcaggaattcgtctcacccctagaaaaaggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccccagggcaccgggggcttcatcgagcccaagtggctggcctatggcgaggtgatctacggccgctacgccatgctggggccgggtgggcgccattcgccccgggagatcgttngccaagattgggcatcattccccccggaaaccgcgcttgcccggggttcaaaaaagggcggttatcccccccggggggggccttaaaattactgggggccgaatcccttaccgcgctcttttggtttttcaaaagggcgctttattggggctttcccccgaaaccccccccccctcccccggaactggttaacaacccgggggcttcccggggggaaaaggggagattttccccggggcccccagaaagatccctctagagaggttccgggggaaaacacctcccaaaccccggggggggggccccttctttaccacccttttgttttttgggnatnccccnggnaaaggcagaaaattgtggcccccctccccccgggagaaaaaaaaaaagggagagttgccccgtggttccacctccccctgtgtatttctttatagggtgggttttcaccgggggggggggcggctcttaaaaagtgggtaaacaccccctcgcaaacaccataataagagggtgttcctccccctcgttcttagaagag

SEQ ID NO: 87767 - protein, 143 aa, Zea mays
  misc_feature: Ceres CLONE 1574907
  misc_feature (55)..(144): Pfam Name: Chloroa_b-bind Pfam Description: Chlorophyll A-B binding protein
  misc_feature (116)..(116): Xaa is any aa, unknown, or other
MAAQALLSGRQLLGRPVQSAVSRSSARKAPFVVRASSSPPAKQGADRQLWFASKQSLSYLDGTLPGDYGFDPLGLSDPQGTGGFIEPKWLAYGEVIYGRYAMLGPGGRHSPREIVXQDWASFPPETALARGSKKGGYPPRGGP

SEQ ID NO: 87768 - DNA, 1068 bp, Zea mays
  misc_feature: Ceres CLONE 1574909
  misc_feature: Encodes the peptide sequence at SEQ ID NO. 87769
  misc_feature (512)..(512): n is a, c, t, g, unknown, or other
  misc_feature (885)..(885): n is a, c, t, g, unknown, or other
  misc_feature (931)..(931): n is a, c, t, g, unknown, or other
ttttttctttttcgttctttgcttctttttttttttgttttttttttgtttttttttgtttttgtgtgcaaactggagctccaccgcggtggcggccgctctagaactagtggatcccccgggctgcaggaattcgtctcacccctataaaaaagcgtgatggcgtctccaatcttaatccatccgatccttgccctgtcctgtgctctcaaatcttcaatccattcggaaaggttcatccaccttcaggcacagcacagtcctcactcctcagtctacactccacactccacactccacacgcaagctcgcactgcgggtggcggtcgcccacctggacctggtaccggaacaccagagctcaaggtcggccatggattcgccactgctgagcacacccgctctgctggcgctgtccctgctccttctagcgctctacatcgctcgccggcgccgcggcggtggtaagaaccaccacccaccctcccgtggcgggcaccgtgttccaccanctgctccacttcaggcggctgatggagtaccaaacagagctcgcccacaagtaccgcacgttccgcatgctcaccccaacctgcaactacgtgtacaccgtggagcccgccaacgtggagtacatccttcagaccaacttctggctactaccgcaaggggagcgatgatccccgacgtgaatagaggacccccctcggccgacagctttctttcaacgtggaacggcctcccaggtggccggcacccagccttaaaaggtaggcgagccccaccagtttctccccacgccgggtgcctgcctccaaataacaacagcgggcagtgtctccgccaacacggcccgtcgatgctcgcttggggattcctagcggnagacggccccggggccacctggcccagaggaaaggctccctggacntcacggaacctcctgatagcgaccgaagctagaactccaattttcaagggcaggttccgggtgcgaccaagggtccatttaacggctgccatgaaaacaagggttcgagcgtcttcgccaaggcgtttcaacccccc

SEQ ID NO: 87769 - protein, 48 aa, Zea mays
  misc_feature: Ceres CLONE 1574909
MEYQTELAHKYRTFRMLTPTCNYVYTVEPANVEYILQTNFWLLPQGER

SEQ ID NO: 87770 - DNA, 1072 bp, Zea mays
  misc_feature: Ceres CLONE 1574911
  misc_feature: Encodes the peptide sequence at SEQ ID NO. 87771
  misc_feature (13)..(13): n is a, c, t, g, unknown, or other
  misc_feature (14)..(14): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
ttttgctttgggnntgcgttccttcttttttctttgatctcccaaaaatatnnnnnnnnnnnncccattttttttaaaagctggagctcaccgcggtggcggccgctctagaactagtggatcccccgggctgcaggaattcgtctcacccctagaaaaaaacaagcactcaacgtctcctccagtccttcgaaaaccctgaaaccttggtgaagccgagacgagcaatcatccaagcagctagtgcttagcatctatggcgacctccgttcgtggtttcagtagcgccctcagggatgtgccgggcagctacggccttccgctggtgggcgccgtccgcgaccgcctcgacttctactacttccagggccaggacaagtacttcgagtcccgcgtcgagcgctacggctccaccgtggtgcgcatgaacgtcccgccgggccccttcatggcgcgcgacccgcgggtggtggcggtcctggacgccaagagcttccccgtcctcttcgacatggacaaggtggagaagagggacctgttcacgggcacctacatgccctccacctccctcaccgggtggccaccgcggtctgcgccttacttcggacccctccgagcccaccccacgcccaaaggtgaagccagcttgctccttctcccctcctgcttctccccgcaaaggacaaagttcatcccccgttctttccggtccaaaatttctccctccgctgcctccccccaccgtccgatatcgggaactccccccaaaggggcgggcaagggcccaatttttaaaaaagctccaaaagaaaattccccctccctttcgaacttccatggggggaagagccatattttggggggtgggcgccccctctgggggaacaggaacccccggcgaaagggggggggggccacaccaagagggggggcccagagtggccccacttttgggggaaatcccaccccggtgtccctctaaagtttgtgggcccccccccgtggggtgcccccaaagaagaacccctgggtctcccccatatgttttccccctcccgccgcctcttttttt

SEQ ID NO: 87771 - protein, 241 aa, Zea mays
  misc_feature: Ceres CLONE 1574911
  misc_feature: SWISSPROT Homolog: EC 4.2.1.92 Hydroperoxide dehydratase
MATSVRGFSSALRDVPGSYGLPLVGAVRDRLDFYYFQGQDKYFESRVERYGSTVVRMNVPPGPFMARDPRVVAVLDAKSFPVLFDMDKVEKRDLFTGTYMPSTSLTGWPPRSAPYFGPLRAHPTPKGEASLLLLPSCFSPQRTKFIPRSFRSKISPSAASPHRPISGTPPKGAGKGPIFKKAPKENSPSLSNFHGGKSHILGGGRPLWGNRNPRRKGGGATPRGGAQSGPTFGGNPTPVSL

SEQ ID NO: 87772 - DNA, 943 bp, Zea mays
  misc_feature: Ceres CLONE 1574912
  misc_feature: Encodes the peptide sequence at SEQ ID NO. 87773
  misc_feature (878)..(878): n is a, c, t, g, unknown, or other
ctggagctccccgcggtggcggccgctctagaactagtggatcccccgggctgcaggaattcgtctcacccctagaaaaacttcctcctataaacccaccgcacctgccttacaggctcccattttctcggcaggagccgcaattccatcctgctgctagagttacatactcacccaatagaacaattctatgcccggtgattgtacctcctgaggtagaagagcatactgaagcagaactcgagtggtgttggatcgaaatggaaggcgggatgtcaagtttggaagccgccatggaagcttcttcatcgatggcaagcagcatggcaaggaatgctgaccctgaccaacagactctccgccccaatttagtggagcagttctattttccaagacctggtcaatctttgccaggcattcctccattttttgggcctccctctagtttgtatcttcctaatgacaatgaagctaaatttggcaacaactttgaatcaaatccttcacagaatacagattggaacccacaggcaatagtgagcaacctaaccttccttgagcagaagatcaagcaggtaaaggatattgtgcagtccatgagtaaccgagagaaccaagtagctggtggttcctgtgaggtagctgcaaagcagcagctcataaccgctgacctcacaagcattataatccagctcatatctactgcgggttcgctgctcccttcaatgaagataccacttcttagcagcaatccagcagtcatgcagcttggcatacactcttggttctcctatgggctttggcatgaatgctaatcagcgaccaagcgtagacagcaagaccgatattccctgacacagaaaaaactctgatatgangaactgatgaataccccttatactagtcaagctgaaagagagagctgatcaatgcccaatccccc

SEQ ID NO: 87773 - protein, 184 aa, Zea mays
  misc_feature: Ceres CLONE 1574912
MEGGMSSLEAAMEASSSMASSMARNADPDQQTLRPNLVEQFYFPRPGQSLPGIPPFFGPPSSLYLPNDNEAKFGNNFESNPSQNTDWNPQAIVSNLTFLEQKIKQVKDIVQSMSNRENQVAGGSCEVAAKQQLITADLTSIIIQLISTAGSLLPSMKIPLLSSNPAVMQLGIHSWFSYGLWHEC

SEQ ID NO: 87774 - DNA, 881 bp, Zea mays
  misc_feature: Ceres CLONE 1574913
  misc_feature: Encodes the peptide sequence at SEQ ID NO. 87775
tggagctccccgcggtggcggccgctctagaactagtggatcccccgggctgcaggaattcgtctcacccctagaaaaaagcctgcgctgcgcgttccgtaaacggaagggtgagaggagtaattacattccagtcctcccgcgccggccgatccgaggccaaagggagggaggagacccctttccctctcgccgccgcacgatggtcgacaccaggcggagctccgcggccaagcgccggggcccgtccgaggactcctccccgtcgccgccgacgacgcaggcggaggccgcggcgaacccgacgacggcgggcttgccggtggagcccgcgtcgcccccgccgtcgtccgggagccgatcgggcaagcgcgccaaggtcgcggttgcgcgagccgaggaccccggtgcgccgcgcggcaaggcggtggaccccgccgcggtcgacgtgctcgacagctccgtggcgaacctgcagggcgtggcgaggccgccggccgccaacgtggccgcgtcctccgccgtgtccaattccgtagggaggaggaagaggaatcagtctgtgagggcgatcccgacgggcgaggggacgctctggaagccgaggcccgccgggtggccgcgctgaggcctgaggcagattgatttcccggtcttccaagtatccctcaattccaatttatactactcatttcactagtggcaatggcgggaaaggtgggacttggaaactcacttgagacatctcctggggccacttatttggcataccgaaagccttgttaaggagggggtggcggcccctttggagaatttacttggaaccaaaggttggtcccctgttcaatgtggaaaagggcctttgggaccaaatacctggg

SEQ ID NO: 87775 - protein, 141 aa, Zea mays
  misc_feature: Ceres CLONE 1574913
MVDTRRSSAAKRRGPSEDSSPSPPTTQAEAAANPTTAGLPVEPASPPPSSGSRSGKRAKVAVARAEDPGAPRGKAVDPAAVDVLDSSVANLQGVARPPAANVAASSAVSNSVGRRKRNQSVRAIPTGEGTLWKPRPAGWPR

SEQ ID NO: 87776 - DNA, 948 bp, Zea mays
  misc_feature: Ceres CLONE 1574915
ggcggccgctctagactagtggatcccccgggctgcaggaattcgtctcacccctagaaaaaaaccaccgcgcactctacacgcgcacgcgctgttcgatcctccgccgctctgtccacccccggccttctccctcttcaacagatctcccccggccgtgcggatccgaaattccccttctccgggactgtcggatctccgcggacgatggggataggcaactgctgcgtgactccgaaagtcaggcgactacgcccgcggcagcaagaagcttgaggatcccaaccccaataatgggaagaaccctaaccccttctcgatcgattacaaccgctcggcgcaggcgagagcgggcaaacttgtggtgttgcgggaacccccccggcccggaataaggggggtggaagaagctacaacggcggagctccggcgtcggcgagttcgggggtttacctgcttctgcgaaaaaccgtggccttgtgggagaggttcctcggcccttcaaagagctattccttcgaaaagaatagcttcggcgattggtcgttggaaggttttcgggactcttctccccccgtgggatgcggagacatcctttgcctcccccttctctcccagaaccccctgagagattggggggtggcccttgggggggatacgggggttggctgggcggaccccgtggctttgttgcggcggttagtgtttaggggaggtggatgttgatggggtgggggaaagcgttccttgtattattgaaaggttctgcgccctggcggaggaaagaagacattgtgaggagtgtgggtgtgccgcccggtggttcttgctggtgcttagtcgggatggcgatcgtcctgccaaagatcagcccctgcatacatggggaggggttcctgagaagtccctcctcctataatggggattatctcctctgttgatgtaacg

SEQ ID NO: 87777 - DNA, 899 bp, Zea mays
  misc_feature: Ceres CLONE 1574916
  misc_feature: Encodes the peptide sequence at SEQ ID NO. 87778
  misc_feature (683)..(683): n is a, c, t, g, unknown, or other
  misc_feature (708)..(708): n is a, c, t, g, unknown, or other
  misc_feature (795)..(795): n is a, c, t, g, unknown, or other
ggagctccccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgancatgtcaagggcaagatccaggacnaggagggcatccctccggaacagcagcggctcatttttgcccgcaagcagctcgaggacgggcgcacgctgccgactacacattcangaagagagaccctcaccttgtgctgcgtctcaggggtggcattgcaatcttctgaagacactactggcaaacatcccccttgaggtggagcctccggacccctc

SEQ ID NO: 87778 - protein, 240 aa, Zea mays
  misc_feature: Ceres CLONE 1574916
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(227): Pfam Name: ubiquitin Pfam Description: Ubiquitin family
  misc_feature (176)..(176): Xaa is any aa, unknown, or other
  misc_feature (185)..(185): Xaa is any aa, unknown, or other
  misc_feature (214)..(214): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIXHVKGKIQDXEGIPPEQQRLIFARKQLEDGRTLPTTHSXRETLTLCCVSGVALQSSEDTTGKHPP

SEQ ID NO: 87779 - DNA, 900 bp, Zea mays
  misc_feature: Ceres CLONE 1574917
  misc_feature: Encodes the peptide sequence at SEQ ID NO. 87780
aagctggagctccccgcggtggcggccgctctagaactagtggatcccccgggctgcaggaattcgtctcacccctagaaaaacggaaaagaaactagacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggagctgagtttgccaagaacaacaacctggaggccctgttccatgtggatgacccccggccgagggtccccatcaagaaaggcaagttcctggacgtgaacgaggctctcgaggtggtccgttttgacatcccgtactgcgactggagggcgcggcatgatcttctcaccatcatggttctccacaacaaggtgggaaaggtccttcaaccccctagcgagggagttccagtccattcgggaccttgagggaaagaacttggccgagctacagccaggagctgggcaaaaccccccaaacagggttcttcccttcggaaacccgagaacttcatctggccctccgaaaaagctatgcgcatttggggagaacccctgggggaaacaaaaagagctgttttcccccccggaacaggagccctctatttaattttccccggggggggggcccccactttcttttggtgtgcaaaggaacatttcttcctacccgccccgtgttctccaacccaagaaaaaccgcccactcttcgggggcccctaaacctagtgggtgg

SEQ ID NO: 87780 - protein, 124 aa, Zea mays
  misc_feature: Ceres CLONE 1574917
  misc_feature: SWISSPROT Homolog: EC 1.13.12.14 Chlorophyllide-a oxygenase
MNTVALLSLAPQLLIKPSLTCFSRKGVGRYGGIKVYAVLRDDGAEFAKNNNLEALFHVDDPRPRVPIKKGKFLDVNEALEVVRFDIPYCDWRARHDLLTIMVLHNKVGKVLQPPSEGVPVHSGP

SEQ ID NO: 87781 - DNA, 922 bp, Zea mays
  misc_feature: Ceres CLONE 1574918
  misc_feature: Encodes the peptide sequence at SEQ ID NO. 87782
  misc_feature (900)..(900): n is a, c, t, g, unknown, or other
  misc_feature (922)..(922): n is a, c, t, g, unknown, or other
ctccccgcggtggcggccgctctagaactagtggatcccccgggctgcaggaattcgtctcacccctagaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcggcaaggttgtggacagtggccccaatgatcatatatttgttttctacagtgaccatgggggtcctggcgtccttggaatgcctacgtatccatatctctatggtgatgacctcgtagatgtcctgaagaagaagcatgctgccggggactacaaaagcctggtcttttacctgaagcatgcgaatctgggagcatctttgaaggcctcctgcgaatgacataatgtgtatgcgaccacgcgtcaaatgcaaaggagagtagctgggggactactgccctggcgagtcccgagncctcccaccgagatgacactgn

SEQ ID NO: 87782 - protein, 220 aa, Zea mays
  misc_feature: Ceres CLONE 1574918
  misc_feature (49)..(217): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGKVVDSGPNDHIFVFYSDHGGPGVLGMPTYPYLYGDDLVDVLKKKHAAGDYKSLVFYLKHANLGASLKASCE

SEQ ID NO: 87783 - DNA, 897 bp, Zea mays
  misc_feature: Ceres CLONE 1574919
  misc_feature: Translation starting site: 675
  misc_feature (828)..(828): n is a, c, t, g, unknown, or other
  misc_feature (837)..(837): n is a, c, t, g, unknown, or other
  misc_feature (858)..(858): n is a, c, t, g, unknown, or other
  misc_feature (869)..(869): n is a, c, t, g, unknown, or other
  misc_feature (872)..(872): n is a, c, t, g, unknown, or other
aaagctggagctccccgcggtggcggccgctctagaactagtggatcccccgggctgcaggaattcgtctcacccctagaaaaagtgttctctcccccgcgcttcccttcaacgccgcctccctaaagatccgccgcttctctgccctctgctcgtcgattcggcgcctcctctccttcacgcgcccacgctgccgtcgcctcctcctcactgtcgtccatgccgctgtagccgcctacggccatggccgctagagccagcgactatttgacggtggagtaccactccagagagctcccctctttcccctccgacgacgagggaggcaccgccggcagtggcgtcctcgtatgcagaacagcagaagacgctcgctcgctctgcgcgcatcgaaccaaaaaccacacctcggcggcagctatataaaagccttcacctgacccgggcgctagggtttattcgctcctcccacccgccgccgtcgccgcctcctctccccagcacccggagctcgctcgaccgccgctcaccatgatcatccccaagaagaaccgcaatgagatctgcaagtacctcttcaaggagggcgtgttgtatgccaagaaggactacaacctggcgaagcatccgcagatcgatgtgcccaacctccaggactccaggtgatcaagctcatgcagagctttaagtccaaggagtatgttagggagaccttctcctggcagtactactactggtacctcaccaacgatggcattgagcacctacgcaactacctgaaccctcggtctgagatcgtgcctgccacgctcaagaagtctgccaagnccacggggnccgcccattggctctggcccntctggtgacgnccnaggggagagcgagatcttgtttggg

SEQ ID NO: 87784 - DNA, 952 bp, Zea mays
  misc_feature: Ceres CLONE 1574920
  misc_feature: Encodes the peptide sequence at SEQ ID NO. 87785
  misc_feature (781)..(781): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
ctggagctccccgcggtggcggccgctctagaactagtggatcccccgggctgcaggaattcgtctcacccctagaaaaaacgcacgcagcaagcacacccggttagcgtccactaatccgcgaaagcttgactgctccaccacgggtcaccggacatccggcttcctcgccccgtcccccgcacgcaggccgccccttaggctcctttgtcattcgaccttcctcttcagcacagcacaagcagctgacaaggttctgacctacaagttccaatgacaatctgcagtagtgaagaaatcattgatgagtttgagttgctaacgcgtgatgctaggcgcgtgcagcaggatacactgagaaagattcttgaactgaatggtgatgccgaatatctgaatcgcttcaatcttggaaggagaacagactcaaagagctttaaatcgtgcattcctctatgtgtgcatagtgacatagagtcctacatccagaggatagccgatggagatgactcgccggtgctaactgggaagcccatcacttccctctccctaagttctggtacgacgcagggaaaacccaagtttttgccattcaatgatgaattgcttgagagtacattccaaatattccgaacctcatatgcctttagaaatcgtgaatatcctattgtcaatggaaaagccctgcagtttgtttacgggagcaagcaagtctttacccaagggggcattcttgcggcgactgcgacgactaatctgtacaggagtcaacgtttcaggnaagcgatgaaggacgtcatgactcagtgctgcagtcctgatgaagtcatctttggtcctgacttccatcagtctttgtactgccatcctatttgtgtgggttatctactcagacgaaagcccaaannnnnnnnnnnnnnnnnnnnnnnnnnnnnnnnnnnnnnnnnnnnnn

SEQ ID NO: 87785 - protein, 211 aa, Zea mays
  misc_feature: Ceres CLONE 1574920
  misc_feature (8)..(226): Pfam Name: GH3 Pfam Description: GH3 auxin-responsive promoter
  misc_feature (170)..(170): Xaa is any aa, unknown, or other
MTICSSEEIIDEFELLTRDARRVQQDTLRKILELNGDAEYLNRFNLGRRTDSKSFKSCIPLCVHSDIESYIQRIADGDDSPVLTGKPITSLSLSSGTTQGKPKFLPFNDELLESTFQIFRTSYAFRNREYPIVNGKALQFVYGSKQVFTQGGILAATATTNLYRSQRFRXAMKDVMTQCCSPDEVIFGPDFHQSLYCHPICVGYLLRRKPK

SEQ ID NO: 87786 - DNA, 926 bp, Zea mays
  misc_feature: Ceres CLONE 1574926
  misc_feature: Encodes the peptide sequence at SEQ ID NO. 87787
  misc_feature (731)..(731): n is a, c, t, g, unknown, or other
  misc_feature (813)..(813): n is a, c, t, g, unknown, or other
tggagctccccgcggtggcggccgctctagaactagtggatcccccgggctgcaggaattcgtctcacccctagaaaaaatctccctctgctccgggcgcaccgtcaccgggtgaggctgtattgcgtcgacagcaacacctgctttcgctacgacgggagcaccagaggctaggcttgcttcatcagtgacagggagccaagatgccggccggagggttctcggtctcggcgccgtccggcgtcgagttcgaggctaagatcacgccgatcgtcatcatctcctgcatcatggctgccacaggcggtttgatgttcggctacgacgtcggcatctcaggtggtgtgacgtcgatggacgacttcctgggcaagttcttcccggcggtgctgcggaagaaactggaggacaaggagagtaactactgcaagtacgataaccagccgctgcagctgttcacgtcgtcgctgtacctcgcggggctgacggccaccttcttcgcctcgtacacgacgcggcgcctcggccggcgcctcaccatgctggtcgccggcgtcttcttcatcgtggggggtgatcttcaacggcgccgcccagaacctcgccatgctcatcgtcggcaggatcttgctcggctgcggcgtcggcttcccaaccaggccgttcccctgttcctgtctgagatcgcgccgacgaggatccgcggcgggctcaacatccctgttcagctncacgtcaccatcggcatcctgttcgcccaactcgtcaactacggcacgtccaagatcaccggtggggggtgggaggctgtcnctgtccctggcaggcatcccggcggcgctgctccccctgggcgcgctcttcgtgacggaaccgccaaaagcctcatcaaggcggccccctggacaagggcaaggccgtgctca

SEQ ID NO: 87787 - protein, 241 aa, Zea mays
  misc_feature: Ceres CLONE 1574926
  misc_feature (204)..(204): Xaa is any aa, unknown, or other
MPAGGFSVSAPSGVEFEAKITPIVIISCIMAATGGLMFGYDVGISGGVTSMDDFLGKFFPAVLRKKLEDKESNYCKYDNQPLQLFTSSLYLAGLTATFFASYTTRRLGRRLTMLVAGVFFIVGGDLQRRRPEPRHAHRRQDLARLRRRLPNQAVPLFLSEIAPTRIRGGLNIPVQLHVTIGILFAQLVNYGTSKITGGGWEAVXVPGRHPGGAAPPGRALRDGTAKSLIKAAPWTRARPCS

SEQ ID NO: 87788 - DNA, 942 bp, Zea mays
  misc_feature: Ceres CLONE 1574927
  misc_feature: Encodes the peptide sequence at SEQ ID NO. 87789
  misc_feature (400)..(400): n is a, c, t, g, unknown, or other
aagctggagctccccgcggtggcggccgctctagaactagtggatcccccgggctgcaggaattcgtctcacccctagaaaaaacccacccaaaattaaaatcctcccggaaatcagagacgcgaatccctcgccccaggccccgaaacctccgagttctctcgccaattcgatccgcctcaccgccgccgcccgtccgccggtcggccttgactgctccgtcgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggcggggttgagggaatggagcacgtccccngagggaagtttaagcttgggaagaagatcgggagcggatctttcggcgagctctatctcggcggtcacatacagagcggcgaggagggggctatcaagttgggaatctgtaaaaatcagggcatccttcagcttccattatgaagtcgaaaactttacatggctttcttcaaggggggaaactgggaaattccttcattttgaaaagggtttggggggtggaaatgggggagatacaaaggggccaggggcccttggaatccttcctgggcgcccagaggctggggaagaaaggttttcacccccgggggcgacccaggaaaaggtttttttctttaaaaaaaaattctttttggccacacgcggataaagaaaataaaaccaggagggaagaagataagtgccccccgcggggggggttccctctccttcggggaaataaaacccgcaaaaaaatttcttttgggggcgcggaggggcgcaaaaaaaacaaaagcggtgttttatttttttaaacaatggggctcctcacaaaaaaaaata

SEQ ID NO: 87789 - protein, 52 aa, Zea mays
  misc_feature: Ceres CLONE 1574927
  misc_feature: SWISSPROT Homolog: EC 2.7.11.1 Non-specific serine/threonine protein kinase
  misc_feature (6)..(6): Xaa is any aa, unknown, or other
MEHVPXGKFKLGKKIGSGSFGELYLGGHIQSGEEGAIKLGICKNQGILQLPL

SEQ ID NO: 87790 - DNA, 918 bp, Zea mays
  misc_feature: Ceres CLONE 1574928
  misc_feature: Encodes the peptide sequence at SEQ ID NO. 87791
ctggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagactactttccggctttacgaaaaaggcaccgctcgtgctccctcagagatcaagccgcacgttctcgtcggcgatctgttactaccgtggcccgtgggggaaaaagtcggctcctgtcacacgacctgctgctgctgccggcgaccgcgaggatcctggggtcccggcatgcccaacaatagatctccacgaagccatctcgtccctgttcctgttcccactgggacgcttccgaaaaggacttaaaacggggcgtcgccccctgccaacataatgtgggaaaggcggggacatttccttatttaaaggggggataaaccccggctttggggaaacaacggggtgggcaacgaacccaactgcgggggctcacaggccgctg

SEQ ID NO: 87791 - protein, 180 aa, Zea mays
  misc_feature: Ceres CLONE 1574928
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRDYFPALRKRHRSCSLRDQAARSRRRSVTTVARGGKSRLLSHDLLLLPATARILGSRHAQQ

SEQ ID NO: 87792 - DNA, 980 bp, Zea mays
  misc_feature: Ceres CLONE 1574930
  misc_feature: Encodes the peptide sequence at SEQ ID NO. 87793
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
ctggagctccccgcggtggcggccgctctagaactagtggatcccccgggctgcaggaattcgtctcaccccctagaaaaaaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgagggtttcgaggcgggggagggggacaacgaggagctcgccattgccaggctcggcctgcccgacgagctcgtcgccacgctcgagaagcgcgggattacgcacctgttccccatccagagggctgtgttgattcccgctctcgggggccgtgacctgattgccagagcaaagactggaactggaaagacactggcctttggcatacccatgatcaagcaattaatcgagcaagacgatggtcggattacaaggagaggtcgtactcctcgggttctggttctagcacctaccagagagttagccaaacaagtcgagaaggaaataaaggaatcagcacccaagctcggcacagtgtgtgttttatggcggtgtctcatataatgtccagcagaatgcactctctcgtggtgtcgatgtgttgtgacactggcgctatcattgatatgcggagctcagtggagagtcatattgtctgagagtaaatgcccatggttgagaatggaattaacctcgcgagaattcgacacggaccagtactcattggaagatgagacgaaggagnnnnnnnnnnnnnnnnnnnnnnnnnnnnnnnnnnnnnnnnnnnnnnnnnnnnnt

SEQ ID NO: 87793 - protein, 202 aa, Zea mays
  misc_feature: Ceres CLONE 1574930
  misc_feature (112)..(202): Pfam Name: DEAD Pfam Description: DEAD/DEAH box helicase
MASLTLPALALALSNPGAVRLRAAAFRCWALRRRGWAAAGALASPNSVLSEHAFKRLQLGSDDEDGEGPYGSDADEGFEAGEGDNEELAIARLGLPDELVATLEKRGITHLFPIQRAVLIPALGGRDLIARAKTGTGKTLAFGIPMIKQLIEQDDGRITRRGRTPRVLVLAPTRELAKQVEKEIKESAPKLGTVCVLWRCLI

SEQ ID NO: 87794 - DNA, 1061 bp, Zea mays
  misc_feature: Ceres CLONE 1574931
  misc_feature: Encodes the peptide sequence at SEQ ID NO. 87795
  misc_feature (392)..(392): n is a, c, t, g, unknown, or other
tccccgcggtggcggccgctctagaactagtggatcccccgggctgcatgaattcgtctcacccctagaaaaagatttctggccggggttgcctggcttggttctccttctggctgctcgctcgcctgcaaccgccaagggagagtaagcaagaaggattggaccgccgtccgccgggacacctcttcctgatccaaatccaagggacggacagctaaagtagctgtggaatatggaagtcgagcaggccgccgaagtaagcgctccagagacggctgatcttaacgtgcctgctaagacgccggtgacgccggcacacgatgatgataaagaaaacgtatccaatggtaatacaaatttgcaagtcaaggaaacacacaatgatgaacaanacccacctcccaactgatggggtttgaactgatagatgtgaaggaaaacttttgactcaccaaaaagtgggggggaagaaaatcgcttgcttcaagaaaggactcacggctggataccatctccctgttcaccagaacaaaaggtgcaacccctcgaaagaaaaaaataaccattcaccattgaaaggaaccaattccggttggctggacaagacaacaaagcaccatgctaggaagttccctcccaattggttttgaaacccagatcaaaatccaggaagcgcccgttttggcacgaaaagccttggaacaaaagggggcttactattgcaagggaaccctcttggcacattcttggaaaaaaaggagtgagaagccttggttaaaagcggacctttttatcctggaaacccagggcataaaccattcccaggaagccgtggttacctaaacagttgtctctctatacaggaaaggcttcagaaggctcttgtttttactttttacaaaaatataagggagtcttttctttcacagcacacagaaagtctttcttaaggggacctggggtttctccaaccttttaaaacctcccaaaaaagaggatccccacgaaattttaagtcccaatttgattatatacagggagataagctttcgaaacccgga

SEQ ID NO: 87795 - protein, 58 aa, Zea mays
  misc_feature: Ceres CLONE 1574931
  misc_feature (54)..(54): Xaa is any aa, unknown, or other
MEVEQAAEVSAPETADLNVPAKTPVTPAHDDDKENVSNGNTNLQVKETHNDEQXPPPN

SEQ ID NO: 87796 - DNA, 935 bp, Zea mays
  misc_feature: Ceres CLONE 1574932
  misc_feature: Translation starting site: 444
  misc_feature: SWISSPROT Homolog: EC 2.7.11.1 Non-specific serine/threonine protein kinase
ctggagctccccgcggtggcggccgctctagaactagtggatcccccgggctgcaggaattcgtctcacccctagaaaaaggctccgcccacctctgcggctctgcctcccttcggcaatggaggcggcgcctccaacttctccaccctccctggtgctactcttgctgctgctgctgctcatcatctctcccccttccagcgctttcctctcccccaagggcgtcaaccctgaagtgcaagctctgatgacgatcaagagcatgctcaaggacccccgtggcgtcctcaagaactgggaccaggactccgtggatccctgcagctggaccaccgtcagctgctcgccagagaatttcgtcaccggactggaggtcccaggacagaacctctctggcttgctctccccgagcatagggaacctgaccaaccttgagacttctcatgcagaacaacaacatcaccggcccaatcccagcagagattggcaagcttacaaagctcaagacacttgatctctccagcaaccacctgtacggtggaatccccgcttctgtaggccaccttgagagcctgcagtacttgaggctcaacaacaacaccctttctggtccattcccttcagcatcagctaacttgtcccagctcgttttcctagacttgtcatataataacctgagtggtccaataccgggatctttggcaagaacattcaacatagttgggaatcctctcatctgcggcaccaacaccgaagtaagattgctacgggactgccccaatgccgatgtcctacaagctcaatagctcgcatggtgctcccgcacaagcaaaatccaaaagccacaaagttgttgcagttgcattcagtgcagcaattggttgcatcagcatcctctccctcgctgccggattcctgttctggtggatgcacct

SEQ ID NO: 87797 - DNA, 855 bp, Zea mays
  misc_feature: Ceres CLONE 1574935
  misc_feature: Encodes the peptide sequence at SEQ ID NO. 87798
  misc_feature (801)..(801): n is a, c, t, g, unknown, or other
ctggagctccccgcggtggcggccgctctagaactagtggatcccccgggctgcaggaattcgtctcacccctagaaaaagagcagcaggagtcggcaaagcaagcttccttccttgcgaacgcaactagtctgctccggattcgccggcccccgccgccgcttcgtcttctctctccctcgtccacggcaaccaactaaccgtcgagatattggcggggcgccgatgctccctgactccccgtagcgcgttgcggatgctgtgggcctgtgaggctcgctgccgccgctttgggatctgggctgctgccggagcggcagcggcggttgtgactggcgccggcgatggcgatgtcggcgaaggagagaaagctgagcaggctcgggagttgtaagggcggtgcggcggctggaagtggcggcggcggcggcggctgcggttcgcctgctgccagggcccaccggtcggtggcggcggcgccgcagcggcgtgtcttcgcggcgctcttcgcgttcctgtgcgccggcgtagtcgtcctcggcggcgtgcacgtcattggagcaacgttccggccagtgctcaggacggcgtggccggcggcaaccctgaacgccatttcctccgatgccagagcgcagcgaggtggcagcagcgccgacaccaccgtgctgccgtcagtccaaatccggcacgcggtcgccatgccggaccgtgtactcctgatcctcaaggacgggccgtcgctgccggctcccgagcggttcgagtgcctgtactcccccgccactcctcggaactgcnacgccacccgaccctcttggccgccctctcgcccgacggacccagcctcgttca

SEQ ID NO: 87798 - protein, 170 aa, Zea mays
  misc_feature: Ceres CLONE 1574935
  misc_feature (153)..(153): Xaa is any aa, unknown, or other
MAMSAKERKLSRLGSCKGGAAAGSGGGGGGCGSPAARAHRSVAAAPQRRVFAALFAFLCAGVVVLGGVHVIGATFRPVLRTAWPAATLNAISSDARAQRGGSSADTTVLPSVQIRHAVAMPDRVLLILKDGPSLPAPERFECLYSPATPRNCXATRPSWPPSRPTDPASF

SEQ ID NO: 87799 - DNA, 882 bp, Zea mays
  misc_feature: Ceres CLONE 1574936
ctggagctccccgcggtggcggccgctctagaactagtggatcccccgggctgcaggaattcgtctcacccctagaaaaaaaaagaggaaaggcttgcggtggatacctaggcacccagagacgaggaagggcgtagcaagcgacgaaatgcttacggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctatatggctaaagtccagtagccgaaagcatcactagcttacgctctgacccgagtagcatggggcacgtggaatcccgtgtgaatcagcaaggaccaccttgcaaggctaaatactcctgggtgaccgatagcgtagtagtaccgtgagggaaatgtgaaaagtaccccagtgggtagtgaaatagaacgtgaaaccgtgctgagctcccaagcagtgggaggggaaaggatctctgaccgcgtggctgttgaaaaatgaaccggcgactcataaggcagtggcttgttttagggaatgggaacccccggaacccttgcggaaagcaggcttcttagggggttggccctggcttgggaaccaaaccggggggatctaccctgtaccggataaaactttggaataaaaaagcgaagggccaacccccgggtttttaaataaccccgaaaaatttgggttagggggtgaatgccc

SEQ ID NO: 87800 - DNA, 936 bp, Zea mays
  misc_feature: Ceres CLONE 1574946
  misc_feature: Encodes the peptide sequence at SEQ ID NO. 87801
  misc_feature (857)..(857): n is a, c, t, g, unknown, or other
  misc_feature (858)..(858): n is a, c, t, g, unknown, or other
  misc_feature (889)..(889): n is a, c, t, g, unknown, or other
  misc_feature (895)..(895): n is a, c, t, g, unknown, or other
  misc_feature (896)..(896): n is a, c, t, g, unknown, or other
acccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgttgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctctgcgacgaccctgatgccttcgcggagctcaaggtgaagagctcaagaacggcgccctcgcatggtctccatgttcgggggtctcgtcaagccatcgtcaccggctagggccgctcgagaactcgtcgnnctactcgcgacccgtcaacaacacgcatgtnctattnncacacttgtgccggatattttgaaggggtgtagcgccacc

SEQ ID NO: 87801 - protein, 234 aa, Zea mays
  misc_feature: Ceres CLONE 1574946
  misc_feature (64)..(213): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGGSFDPLGLCDDPDAFAELKVKSSRTAPSHGLHVRGSRQAIVTG

SEQ ID NO: 87802 - DNA, 838 bp, Zea mays
  misc_feature: Ceres CLONE 1574947
  misc_feature: Encodes the peptide sequence at SEQ ID NO. 87803
tggagctccccgcggtggcggccgctctagaactagtggatcccccgggctgcaggaattcgtctcacccctagaaaaaaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatgccacttttgtggatccgcatccgggaaagaccttccccaattctggaccttcgtacaggggaggggattgccccatgtggcttaagggggaccccaaggaaccttaaccgtgcataaacttgggcttccaagggctttttaataaaggggcttgggccaaaaaaaaacgccctttaaaaggggccccgattcccacaggggggggttgcggatttggaaaaagaaacccccttgtgccccttttttttttttttgggaaaatgggggaaacccgggggaaccctttttgggccgcgccccccccacaattaggaagcacccccgggggggggcgcccctttttagggcggttacatttcgggggggggggggcggaaaaaaa

SEQ ID NO: 87803 - protein, 109 aa, Zea mays
  misc_feature: Ceres CLONE 1574947
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINATFVDPHPGKTFPNSGPSYRGGDCPMWLKGDPKEP

SEQ ID NO: 87804 - DNA, 856 bp, Zea mays
  misc_feature: Ceres CLONE 1574948
  misc_feature: Encodes the peptide sequence at SEQ ID NO. 87805
  misc_feature (761)..(761): n is a, c, t, g, unknown, or other
  misc_feature (845)..(845): n is a, c, t, g, unknown, or other
  misc_feature (852)..(852): n is a, c, t, g, unknown, or other
caaagctggagctccccgcggtggcggccgctctagaactagtggatcccccgggctgcaggaattcgtctcacccctagaaaaagcttcgcctacggcatattcccccgaggccccgaaccaaaccaaaccaaaccaaaccaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgtcggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatgaagtgcaagtatgtagaactcacttcagactttgtgtatccctacagaaatcagggtggatttgatatgatctgcagtggaagggacaagattgaaacaccggagcagtttaagcaagctgaagacacggccaacaagcttgatttggatggacnttgttgtcattggtggtgatgattcaaacaccaatgcctgcctccttggtgaatactttaggtcaaggaacatgaaacccgtgntattggntgcc

SEQ ID NO: 87805 - protein, 195 aa, Zea mays
  misc_feature: Ceres CLONE 1574948
  misc_feature: SWISSPROT Homolog: EC 2.7.1.90 Diphosphate--fructose-6-phosphate 1-phosphotransferase
  misc_feature (190)..(190): Xaa is any aa, unknown, or other
MAAAAVTSNGGAVAANGPAPGRLASVYSEVQTNRLLHALPLPSVLRSNFSVVVGPASSAAGNPDEIAKLFPNLFGQPSASLVPSAEPAATRPLKIGVVLSGGQAPGGHNVICGIFDYLQERAKGSTLYGFKGGPAGIMKCKYVELTSDFVYPYRNQGGFDMICSGRDKIETPEQFKQAEDTANKLDLDGXCCHWW

SEQ ID NO: 87806 - DNA, 936 bp, Zea mays
  misc_feature: Ceres CLONE 1574949
  misc_feature: Encodes the peptide sequence at SEQ ID NO. 87807
ctggagctccccgcggtggcggccgctctagaactagtggatcccccgggctgcaggaattcgtctcaccccctagaaaaaactccttcctccattcctccaagccacgccacacctcggcgcgtcccgccaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaagaccgcccgtccccgcctgccgaggaggacgccaagcgctacgggctcaacgggaacgggagcgggctcggatacgacgatgccgccgtccaagcgtacctcggaagcaacggtaacggtagcgccagcggtaacggcggggcggtgaagcagaaccccgaggttgccgggagcagcgcggccatagtcccggccccggtcccgccggcggagggtgagaggagaggaaggagagagtgagagatcttcggggggggggggaggatgcctggttcaagcagagcagcgcagaggtttctgttgctcctggtggtcgctggaatcggtttaaaacctattcaacaattcaaagaacactggaaatatggggattcgtttttacatttatattcaagggcttggctcaacaatcaaaagtcacatacagaggggggatgactgaggagaaaaaataatgaggaagaaagttcttgccaagcggctaaaggagagcttttgagataggcccacattctcaaaaagggcacaatcctcaccggggtggaattctccacagaatatggggatcactaccaaagtacggacaagtcctccttttctt

SEQ ID NO: 87807 - protein, 131 aa, Zea mays
  misc_feature: Ceres CLONE 1574949
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSASGNGGAVKQNPEVAGSSAAIVPAPVPPAEGERRGRRE

SEQ ID NO: 87808 - DNA, 927 bp, Zea mays
  misc_feature: Ceres CLONE 1574951
  misc_feature: Encodes the peptide sequence at SEQ ID NO. 87809
gcggtggcggccgctctagaactagtggatcccccgggctgcaggaattcgtctcacccctagaaaaaactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctttgggcgccaagtgtgtacatcttgctcctcgcaaagctcattgatggggtccgtatcggtttggcggtcacacttgttcctctctacatctccgagactgcaccgacagacattcgtgggctgtttgacacgttgccgcagttcagtgggtcaagaaggatgttcctctcctactgcatggggtttgggatgtccctcatgcccaaccctgattggaggctcctgcttgggagtcctgccgatcccggtaccttatttacttgggaaggacggtctcctacttgcctgatcacccagggggccttgttgaacaagagaggatgcggaagccaataaaattttcaaaagctgcggggaaaaaaaaaga

SEQ ID NO: 87809 - protein, 202 aa, Zea mays
  misc_feature: Ceres CLONE 1574951
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLLAKLIDGVRIGLAVTLVPLYISETAPTDIRGLFDTLPQFSGSRRMFLSYCMGFGMSLMPNPDWRLLLGSPADPGTLFTWEGRSPTCLITQGALLNKRGCGSQ

SEQ ID NO: 87810 - DNA, 948 bp, Zea mays
  misc_feature: Ceres CLONE 1574953
  misc_feature: Encodes the peptide sequence at SEQ ID NO. 87811
aaagctggagctccccgcggtggcggccgctctagaactagtggatcccccgggctgcaggaattcgtctcacccctagaaaaaggcgctcaccaaaaccacccagaagcctccgcttgaccgcttcactcgctttccgcccgccgcgccatgagcgccgccgcctgcctgttcgctgccgccgtctccctatcattcccgtcaacctccgcaccctcttccggaagacgccgccgcctccggagccccagaaccctcctccgctgctccccgactcgccgccgtgggccggtccggcagacactcgacgagcggctgctcgaggccgcgccggcggagaccgaagacgtccaaaccgctgttgatgtagaggatggaggagggatcgctgagggcgatgaagtgggaacagaggagatggaggagctggagcatcgaccgccgacaagggctttcgtgaagagcaggcggcagcggcaggaagaggaggaagccgcggcggggcaagaccggttcaagctcatcaatggcaaagagatatttcaagagaaggcttatctggttggtgttgagtgccaacggacaggagggaacctgttcggcatataggagtcccttaaggagctggagcagttggctgatacggcgggccttctggtagtcggctcaacctatcagaagctgtctaccccaaatccaaggacttacattggttcacgagtagtttctgacatcaggactgcaatccaagcacttgatgttgagactgtgattttagacgatgagtcttcccctggacaactagcatacttggaaaagtcttctggtgggagtgtccgaatctgtgatcgaactgctcatattctttgatattttgatgcaaggcaagcacagatggagcttctattcggatgaattggcacagagggatatcaacttcgagggtcg

SEQ ID NO: 87811 - protein, 152 aa, Zea mays
  misc_feature: Ceres CLONE 1574953
MSAAACLFAAAVSLSFPSTSAPSSGRRRRLRSPRTLLRCSPTRRRGPVRQTLDERLLEAAPAETEDVQTAVDVEDGGGIAEGDEVGTEEMEELEHRPPTRAFVKSRRQRQEEEEAAAGQDRFKLINGKEIFQEKAYLVGVECQRTGGNLFGI

SEQ ID NO: 87812 - DNA, 931 bp, Zea mays
  misc_feature: Ceres CLONE 1574959
  misc_feature: Encodes the peptide sequence at SEQ ID NO. 87813
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
ctccccgcggtggcggccgctctagaactagtggatcccccgggctgcaggaattcgtctcacccctagaaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaatgtttcaacctcccatctgctagctatgatacagatggtcccctgataataatgatgacatattctgtgatggatgccacagcattttttgttttnnannanannnnnnnnnnnnnnnnnnnnnnnnnnnnnnnnnnnnnnnnnnnnnnnnnnnnnnnnnnnnnnnngacaccacgaggcaaataaacccagacgtagttcagctagccgcttatacctccctttcccccccccgcctgggggttgccgggagagctcgttcctgatggggaactgccccggcttggaggggacgcctagatcaaccctttcttcattgccccaatcccctaaggaacgccgggttctaatacgtcagcaaaaacgcggccgaccccgcacttttgggacaaaaaatcccgtttcttcttcttt

SEQ ID NO: 87813 - protein, 62 aa, Zea mays; identical to SEQ ID NO: 5990
  misc_feature: Ceres CLONE 1574959
  misc_feature (1)..(62): Pfam Name: TMA7 Pfam Description: Translation machinery associated TMA7

SEQ ID NO: 87814 - DNA, 1017 bp, Zea mays
  misc_feature: Ceres CLONE 1574960
  misc_feature: Encodes the peptide sequence at SEQ ID NO. 87815
acccgcggtggcggccgctctagaatagtggatcccccgggctgcttgaattcgtctcacccctagaaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcggaagaagaaagatgaggaaaaagcactgaaggagcttaaggccaaggcacagaacggcgcgattgggggctcgggtctgaagaaaagtggaaagaaatgagactggtcacccgtctccaccaccttgaggatgataaggcagctgtctatctgtgttgcgcttcactaagtgtgattgtaacagtggtacctcttgtgttctgtgttccgctatgttgcccttggttgcttgatcgaaatgtttcaacctcccatccgctatctatgatacagatggtcccctgataataatgatgacatattcttgtgatggatgccacagcatttttttgttttaaacaattaagccctccgtttgaaggttttaaacttcgcaattataatatccaaggatgttacacccaattatattttccctcccagtgggataattaaacccctaagatttttcaagctaacctttttttattatcccttttccctccccttacttgtacgccgatccggatgaaagtccctttccctaatgtgggaaatttcccctacgggtctgtgaggggaacaccccgaattataagcctcttcctctactcgcaccccaatattcctacagggatcagcgactgtgttttatatatacggtttcatagaaaacgcttgtctctaactcggtactccttgtgagcatatataattgatcctgtggcgtttttcttccgttgtttgccgctctcctacaccg

SEQ ID NO: 87815 - protein, 62 aa, Zea mays
  misc_feature: Ceres CLONE 1574960
  misc_feature (1)..(62): Pfam Name: TMA7 Pfam Description: Translation machinery associated TMA7
MSKQGGKAKPLKAPKADKKEYDETDLAYLRKKKDEEKALKELKAKAQNGAIGGSGLKKSGKK

SEQ ID NO: 87816 - DNA, 880 bp, Zea mays
  misc_feature: Ceres CLONE 1574961
  misc_feature: Encodes the peptide sequence at SEQ ID NO. 87817
  misc_feature (522)..(522): n is a, c, t, g, unknown, or other
ctggagctccccgcggtggcggccgctctagaactagtggatcccccgggctgcaggaattcgtctcacccctagaaaaaaaccaaccctccttggctggactggacccccaacccaacaacagcagcaggaacaggaaaaagaaaaaactctctcccattcccatctcgcctcccacctcctccgcctcgccgccgcggcaggcaccgccaccaatcttctcttccgccccctcgttcgttcgctcgctcgctcgccaggagatcgactcgaggcgaggccatgaagtacgtgctggtgaccggcggcgtggtgagcgggctcgggaagggcgtgacggccagcagcatcggcgtcgtgctcaaggcctgcggcctccgcgtcacgtctatcaagatcgatccatacctcaacaccgatgccggaaccatgtccccattcgagcacggcgaagtgtttgttttggacgatggtggtgaggtggacttggaccttggaaactatgagagaattctggacatncagttgactcgtgacaacacataaccacgggaagatataccagtctgttattgacaaggacgttgaaggaatttcctgggaaaaacgttcagggcgtgccccccttcccggatgaaattcaaaatgggattcaacgggggggcaatgaaatccgttgaagaaaccccaaaacccccttaattttgggtcaaaaaactgggggggaattaggggaaactaaaacaagggccttttaaaaaacccggggaatttttaacccggggggggcgagaaacttttgtgtgggggggtttattcttccccccttttaaagagggggggggagaaaaaaaaaacccccccaaaggtgtgggggcgt

SEQ ID NO: 87817 - protein, 87 aa, Zea mays
  misc_feature: Ceres CLONE 1574961
  misc_feature (1)..(88): Pfam Name: CTP_synth_N Pfam Description: CTP synthase N-terminus
  misc_feature: SWISSPROT Homolog: EC 6.3.4.2 CTP synthase
  misc_feature (80)..(80): Xaa is any aa, unknown, or other
MKYVLVTGGVVSGLGKGVTASSIGVVLKACGLRVTSIKIDPYLNTDAGTMSPFEHGEVFVLDDGGEVDLDLGNYERILDXQLTRDNT

SEQ ID NO: 87818 - DNA, 1048 bp, Zea mays
  misc_feature: Ceres CLONE 1574962
  misc_feature: Encodes the peptide sequence at SEQ ID NO. 87819
ctccccgcggtggcggccgctctagaactagtggatcccccgggctgcaggaattcgtctcacccctagaaaaaccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggtagaccggcggcggcaagatcaccgacgagttcaccggcgccggcgccatcggccaggtgtgccaggtgatcggcgccgtcgtcgacgtgcgctacgatgatggcctcccgccatcctcacggggctcgaggtgctcgacaacgacatccggcctcgggctccaggtgggcgcaacacccttgccgaaaaactgggggcgccccattccctttggaacgggcccggaagggctttcgttcccgggccaagggggttcccttaacaattgggttccccccaattacccgtgtgcctgtttgggcaggggcctcccccttggggaacgattactttttaagggttttccgcggggaccccccttttttttgaaaaaaggggggggatatttaagaaaaaaaaacaatttttccccccccttatccattgtgggaaaaccccctcttttttttgtttgaaacggcgcccccttgaacacagaaaatcttttttgttccgaaaaataaagggggcggggatttttctctcgccccccccccaaaagggggggagaaatattggtcttttccgggggggggggggaggggggaaaaacatgtcgcctcttgtggggactaaaaacaaagtgttcaaaaccgccgcgggggttctccccttgttggcgggggggagaaaacacccgccaggagagacctccctctaaa

SEQ ID NO: 87819 - protein, 65 aa, Zea mays
  misc_feature: Ceres CLONE 1574962
MASRRVVSSLLRSASRLRAASPAAPRPRGAPHRPSPAGYLFNRAAAYASAAAAQAAPATPPPATG

SEQ ID NO: 87820 - DNA, 882 bp, Zea mays
  misc_feature: Ceres CLONE 1574963
  misc_feature: Encodes the peptide sequence at SEQ ID NO. 87821
  misc_feature (828)..(828): n is a, c, t, g, unknown, or other
  misc_feature (829)..(829): n is a, c, t, g, unknown, or other
gagctccccgcggtggcggccgctctagaactagtggatcccccgggctgcaggaattcgtctcacccctagaaaaagcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatgggagcatctgtttggatatcctacagaaaccagtggagtcctatatatgatgttgctgcaattttaactttctatccagtcccggctgggtgatccaaaccccaactcccctgcaacctcagaagcagcaagactgtttcccgagaaacaaccgggagtacaacccccaaattccttgaaattctgggaacaaaacctggacaccccactaatggcaaaagggagctcccccgggcccccaaaggggcccaaataaaaaagcggggaaaaaaaaaaacccccccccccccttgggttttcggggtccccccggcttgtgttcaaaacattgagaaacccccccgggattggggttgtgaaacttggggnngaccctgttttccccccccaaaaaaaacccccgggttttctcctggggggggg

SEQ ID NO: 87821 - protein, 100 aa, Zea mays
  misc_feature: Ceres CLONE 1574963
  misc_feature (8)..(100): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKLTLQFTEDYPNKPPTVRFVSRMFHPNIYADGSICLDILQKPVESYI

SEQ ID NO: 87822 - DNA, 1150 bp, Zea mays
  misc_feature: Ceres CLONE 1574964
  misc_feature (1150)..(1150): n is a, c, t, g, unknown, or other
tccccgcggtggcggccgctctagaactagtggatcccccgggctgcaggaattcgtctcacccctagaaaaagtgcctgcgccattggggcctgtttggagagagtctggatactcctgaagctccaggcagtaagcgatggaaaggagggactcaatcagttagcctgatggtgcaccttgctgtgccatggctctgcatagattcttggagtccttctgctatgagtgcttgcatgtggaaatgaaggtgcaacagctccaataccgagaccagattacataattttgaacttatgcaccgcttcggtcgaacgccgaagagtcctagattttttatagctactgttcatactggcctggtgttggaatattgtgtggtaacttgaatatgtcccccccccatatggtttaaaataaaccccccgctgttgaaataggtttaaaaacatcaagtcagttttacaaaaggaagcgctcttcctcgttgcgttgtatgaagtgaaggtttcatagaattcttatttttattttatcttttcattgttacggagttgcgatgtatttgtctttggtacatgattaacatatagcagttatatatcgtgatgttttgcttaagtctacgttgctaagtgttggttcccttttggtgtgatataaatcgtttccggacttcccctttgaatattatagctggaataacgtattgttccctatcctcctacacagggaccatagtgtataaacttgtactccgtgccgtcggcgcgtgattatatgagtgttcataactccacagagaaccacatagggagttcctttattgtgttttgccgcgactacgggtagattgatatcagctccacgaagacatatgattaccgttatttcacttgggccgctgttttgcactctacctggtatatccatctcttatatctatattatcaatgataatgaatggggatattgatgtgcagtgcgagttaatacttatatggtttgcccaaccccatgcttgatagtttctcaagttatatgtatttaggatgagtatgacttgatcctgtgatgttaataatctgaaattctatttagatacgaacgtagtcttcacatttgagtgctatcatgagacttaagagan

SEQ ID NO: 87823 - DNA, 849 bp, Zea mays
  misc_feature: Ceres CLONE 1574965
  misc_feature: Encodes the peptide sequence at SEQ ID NO. 87824
ctggagctccccgcggtggcggccgctctagaactagtggatcccccgggctgcaggaattcgtctcacccctagaaaaaacacctcacctccgccacccgggtgcttacgtggcgcggcaccaccagctgatcctgatcggcgcaggaacggagtaaacgcttgctggctctctaatccccgtccctcatccctcaccctttgcaaaaatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcccccgctcgaactgcctcagggcgctccacctgcgccgcatgaccgtcacccgacgaggaacaatcgccgtgctccttccgcgcgcggcggccacaatgctacagggtgctcaaggctcgaaaaaagtgctcccgggctttcttaaaagggagcccctcccggccttggtttgcccgccttcctgggagaa

SEQ ID NO: 87824 - protein, 128 aa, Zea mays
  misc_feature: Ceres CLONE 1574965
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPARTASGRSTCAA

SEQ ID NO: 87825 - DNA, 880 bp, Zea mays
  misc_feature: Ceres CLONE 1574967
  misc_feature: Encodes the peptide sequence at SEQ ID NO. 87826
  misc_feature (400)..(400): n is a, c, t, g, unknown, or other
aagctggagctccccgcggtggcggccgctctagaactagtggatcccccgggctgcaggaattcgtctcacccctagaaaaaaaaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacnatccccaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaggctgagagacagattcctgcgtcagttgcaggagctgctcctgcagctgttgtttccaatgggaaaaagataattgaagatgaaattgggccctgacgggaaaaaaaatccgtcctgggaaccacccctgtcatggattgatgaacctttcaaagggtaaatggccatggcttttccggcacaagcgcaaagaaaaaaacaggggttctctccaactcctgggcgaccgaatcggaaggcccctccagagaaaaaaac

SEQ ID NO: 87826 - protein, 162 aa, Zea mays
  misc_feature: Ceres CLONE 1574967
  misc_feature (64)..(133): Pfam Name: Prp19 Pfam Description: Prp19/Pso4-like
MICAISGEVPDEPVVSKKSGLLFERRLIERYIEDHGKCPATKEDLTMDDIVPVKTNTIPKPRPLQAASIPGLLGIFQNEWDALMLSNFALEQQLHTARQELSHALYQHDAACRVIARLKKERDDARALLAQAERQIPASVAGAAPAAVVSNGKKIIEDEIGP

SEQ ID NO: 87827 - DNA, 1296 bp, Zea mays
  misc_feature: Ceres CLONE 1574971
  misc_feature: Translation starting site: 258
  misc_feature (70)..(70): n is a, c, t, g, unknown, or other
  misc_feature (71)..(71): n is a, c, t, g, unknown, or other
  misc_feature (927)..(927): n is a, c, t, g, unknown, or other
  misc_feature (1177)..(1177): n is a, c, t, g, unknown, or other
gtggtgtgtggtatgcgttgctaacttatttacccttttaatatagggaccctctaccattagatgattnnaacaaactggagctccccgcggtggcggccgctctagaactagtggatcccccgggctgcaggaattcgtctcacccctagaaaaaggaaccagaacaagtccagtctgtccagaaatacattagaaaaaagagccaaagaggagaacaccggccggcgaggtggacgaagcggcccgccgaggaaatggcgtcgatgcagagctggcgcaaggcctacggcgccatcaaggacaccaccaccgttagcctcgccaatctcaactccgacttcaaggtgtgccttcgatccggatctggatgtggcgatcgtgaaggcgactaaccacgtggagtgcccgcctaaggagcgacacctgcgcagggttgttgcggcgacgtccatcaccaggcctcgggcagatgtcgcctactgcatccacgcgctttgcccgccgtcttgcccagacacgcaaactgggattcgttgctcctaaaagcactttgtagtggatccaataaaactatcttccgcgaaggggtgaatttcttacatttttcccaggaaagagctttcttcacactttttaccccccaaagggggagatgggaattcctctgcaaaccttttcccaaaactttttaaagggaatatgaaatctccccggttcccaaaattttgttttctggggggcattttggattatctggcgcccgcgggggcgggtgaatacctaaccataaagagagtggctttatggggacactccttcgaggggagagaagcaaaaataagcgcgttctggccgcaaatctggcgtcttgtccaccaaaaatgaatttattttgcaaaaaataagtttggaaatatcggttcngaataaaaattcttgcagagacgttccctcttgtggttcaccacaaaacatatgattggtggtctcaagcgggcgtccccctcgcgcggataaaatggggtcccacccctcactgtatcgcacacaccgcactcaaataataatttttgtgggatattctcaccacccggacgttatcttagtgtaaatataacaacgagtcatgggccccaagaacaattttggcaagagctgttattgtgagcgttgntcacacccgacacactttgttgtttgggaatagctcgttggcgtcttctgtatatgggagtcctcttcgaacatataaatatgaacctttctcttgtgagaccgacataattcgttctt

SEQ ID NO: 87828 - DNA, 971 bp, Zea mays
  misc_feature: Ceres CLONE 1574972
  misc_feature: Translation starting site: 145
caatgctgtagctcaccgcggtggcggccgctctagaactagtggatcccccgggctgcaggaattcgtctcacccctagaaaaactaaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggctcggctgggcggcggcgggcgccctggcctcgcccaactccgtgcttagcgagcatgccttcaagcggctccagctcgggagcgacgacgaggacggggaagggccgtacgggagcgactccaacaaagggttcgaggcgggggagggtgacaaccaccacctcgccattgccaggctcggcctgaccgacgagctcgtcgccacgctcgagaagcgcgggattacgcacctgttccccatccagagggctgtgttgattcccgctctcgagggccgtgacctgattgccacagcaaagactggaactggaaagacacaggcctttggcatacccatgatcatatcaattaatctagcaagacgatggtcggattactaagagaagtcgtactcctcgggttctggttctagcacctaccagagagttagccaaaacaagtctagaaagaaataaaggaatcagccccctggctcgggcacaaagtgtgtttaatggccgggtctcatatatagtcccgcagaaagccctccctcccggtgtccaagtttttgttgtaacaacctggcccgcctaaactaatttgataaaaggggggaaaccccccaggtggggaaaagatcagtattgggtccctgtaatgatggtgaaccaatatgtccccaagggcagcttggaaggaaatgtgggataaaaaatataaaaacacttccctgcaggtgtgagaa

SEQ ID NO: 87829 - DNA, 862 bp, Zea mays
  misc_feature: Ceres CLONE 1574974
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
atagctggagctccccgcggtggcggccgctctagaactagtggatcccccgggctgcaggaattcgtctcacccctagaaaaaattcctcacacccacacaaaccgcacctcatccctgttgacccgacggtggcgctcatctcctccccgacggtggcgctcatcttccccccgacggttctccccatcgacctgctggcttcccttcgtcttccccgacactgatcctcaccactcatgtctgctgaagttgccggaggaaaccttatttcctctcatgctacttctggttcatatactgcataaaatccgagatttccttgatacaagtggaacactaggattttgtgcaatacttcctacatgtgaatagttgagctggtgaatttggaagactcaagtctctcatctgggtcagaaacatctgtcggttgatttgctggtctcctgtttcccttgagtcttgccaaccaaagttttctctcagcatcaagtgtgggtctacaaactctttctgtggacttgaccaacatccccttttgggtcctgtcaaatcttgcaaaaactccccttccaaaggactttgccttagaagccggaattggcccgtgttctctggcgggggcctggaaccccccctttagacctccaaggttttcccctgggcaggcagtgtgggattcaccaaaacccttttggggaattggaccaaaaaccctttttggggccgggaaatcttggaaaaaccccccttttaaaaaaattgtcttaaaggtgggaattccccctgttgnnnnnnnnnnnnnnnnnnnnnnnnnnnnnnnnnnnnnnnnnnnnnnnnnnnnnnnnnnnnnnnnnnt

SEQ ID NO: 87830 - DNA, 865 bp, Zea mays
  misc_feature: Ceres CLONE 1574975
  misc_feature: Encodes the peptide sequence at SEQ ID NO. 87831
aagctggagctccccgcggtggcggccgctctagaactagtggatcccccgggctgcaggaattcgtctcacccctagaaaaactagaaaaaccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcccgcgcgccggccgcctcttctcccccgccttcgccacctccgtctctggagacttcctccgcccgcacggcgggggcgcctccggcacccccgagatcggagattcacattttgagccacgtgagcgtgttcgatacacaagagatcaacttctcgagctgcgtgagattgttgatgtgtctgaggaaattttaagaatcaagcaagagattgatgtagagcttcatggtgaagaccagagctgggttcgcaatgattcacctgttcaaggacgagcacaagctctaacacaagcacagaatcgctatgctgagactgatagcccgtgattggcgtgcacgggtctgcacagctggactccgactaattgaaaaaaaatcttgggacaccttaaggggaggggtaaagaaaccttatgccctcctaccggtaggccaccaaagaccagcttaaccggggaaaaataccggtaagagctcccccgttttttgttcccaaaaactcagggggtgggccccaacccccggggttttttataaggagggggagaagaggccc

SEQ ID NO: 87831 - protein, 126 aa, Zea mays
  misc_feature: Ceres CLONE 1574975
MQPDQPVISLRPGGGGGPRAGRLFSPAFATSVSGDFLRPHGGGASGTPEIGDSHFEPRERVRYTRDQLLELREIVDVSEEILRIKQEIDVELHGEDQSWVRNDSPVQGRAQALTQAQNRYAETDSP

SEQ ID NO: 87832 - DNA, 985 bp, Zea mays
  misc_feature: Ceres CLONE 1574976
catagctggagctcaccgcggtggcggccgctctagaactagtggatcccccgggctgcaggaattcgtctcacccctagaaaaaatgcctagctgagaggcaaagaaagactaagaaaagaggatgactcagggtcattcatagtcctgcttccaacaattttggatatggagttcaaattgataggaacatcggcatcttggccatccagctcctgccatctcttggatcatcaataaacctgtctgacaagctgccgaagatcatcatatctccctactattgctgctacagatactgggagctgttcctcatagtacaggtcatttactccacctggatctgcccgattgaactagaatttttgctgaacttggaatctaagctaccgcgagataataacaacgacaatggcttcttcgcgggtgatatgagtactgacgttcttcgaatgttaggtctacacgctaaacacagattcttgtggatgacgagaacacaattgcatgtaaggtacctatcaacctggttcatgtgtgatgaatgttcaacagctccgtttcaacaatttagccttctcttctcacgtaaagtgaacggccttggtattaacacagcccacatgttggaggctatggcgccttcaccgagtcaagtctctgtttgcaaggctggagaaggacataaggctcaacgttttctgaactagatgctcaaaggtaatttcagttacgcagatcgccgtgccaaggacgggggtgcttcaactgaatgacctgccaatgtattggtgctccagaataaaatagggataggcgggtgtatgcctagccttcaaatccgaaaagcttatgggcttaaatacgtaaatggccctttactggacgagttaatcccctaaacacggcaagttaaaggggcgtatctctctgggggagaaccccaataaaactccttgattgaatatccgctcatttgctggtg

SEQ ID NO: 87833 - DNA, 852 bp, Zea mays
  misc_feature: Ceres CLONE 1574977
  misc_feature: Encodes the peptide sequence at SEQ ID NO. 87834
ctcaccgcggtggcggccgctctagaactagtggatcccccgggctgcaggaattcgtctcacccctagaaaaaacggagaaaaagaaagaggagctcggacaaggcagagcgccatcgttcggtttccttgctgaattcccgatcgctcgctcgctcgaaaagaaagaagctagcttttagcatggcgtctctggcgttcggcagcaccgtagcggcggccgtggcggcgacatcggggaggacacggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacgcgcgccccaacaaagtcggcgccgcgccggccgccgcctcccgcgccaagacgaccgccggcaagaaggctgccggcggcgacgacagcggcagcggcggggggttcaacctcggcggcctcggcgggctcttcgccaagaaaaagcagctgaacgtggcgttgtttatggattgtcgaactcaaagctggatttggcttttgagggggaaatgggtgcgcatatatatttgtggacctgtggtggtgtgacccgggatctttgaaggcaaaatgggatatactctaacttccaaaaaaaaagcccccgcggggagcaacagccaggccaaccaccttctcggtgggaaacttgccaacggcgaaattcaatcttccggcccggacctggttggaccatggtttaaagtccgggaaaatgggccagtttataatcagggcggagccagttcctcgtggggagcccgg

SEQ ID NO: 87834 - protein, 150 aa, Zea mays
  misc_feature: Ceres CLONE 1574977
MASLAFGSTVAAAVAATSGRTRPARRSVLVVPPAASRGGPAPAKEEKGLGETIFGFIFKKDQLVETDARPNKVGAAPAAASRAKTTAGKKAAGGDDSGSGGGFNLGGLGGLFAKKKQLNVALFMDCRTQSWIWLLRGKWVRIYICGPVVV

SEQ ID NO: 87835 - DNA, 1046 bp, Zea mays
  misc_feature: Ceres CLONE 1574980
  misc_feature: Encodes the peptide sequence at SEQ ID NO. 87836
  misc_feature (15)..(15): n is a, c, t, g, unknown, or other
  misc_feature (16)..(16): n is a, c, t, g, unknown, or other
  misc_feature (68)..(68): n is a, c, t, g, unknown, or other
  misc_feature (69)..(69): n is a, c, t, g, unknown, or other
  misc_feature (1046)..(1046): n is a, c, t, g, unknown, or other
gggaggggaaaaaannagaaataaaggaaaagaaacaaaaaaaaaacaccgaccacaacaaaacaaannccctcaaaaaggaccccccggcggggcggccgctctacaatagtggatcccccgggctgcttttattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgcgctccgcctcaggggaggcatgcagatctttgccaaaccccccaccggcaagactatcaccctcgaggtggagtcctctgacaccattgacaacggcaaggccaagatccaggacaaggagggcatcccctccagaccaggcagcggctcaatctttgccggggaaacaacttgagggacggggcggcacgcttggccgactaacaccatccagaaaggaaaagcacccctccaacttggtgcctgacgccctcagggggagggaatggcaagaatcttccgttgaaaaaaccctgggccggggaaaaaacaaatcgacccctgcaaaggtgggaagtacttcgggaacacccaagtggaacaaacggccaaggggctaagaaatatcaggtaaacagggagggggcatttcccaccaaataaatagcgagggaggcattaaatcctttggatggcgaaaggcaacctcgataaggaccgggggcctacacctagggcgagaagtaacaaagaaatcgtaaaaaggagaaggcaaaccattccgcagtggtctgccgcgatctccacgagggagggagagccagtgtacaaaccactctggcaan

SEQ ID NO: 87836 - protein, 127 aa, Zea mays
  misc_feature: Ceres CLONE 1574980
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLALRLRGGMQIFAKPPTGKTITLEVESSDTIDNGKAKIQDKEGIPSRPGSGSIFAGETT

SEQ ID NO: 87837 - DNA, 915 bp, Zea mays
  misc_feature: Ceres CLONE 1574981
  misc_feature (277)..(277): n is a, c, t, g, unknown, or other
  misc_feature (340)..(340): n is a, c, t, g, unknown, or other
  misc_feature (458)..(458): n is a, c, t, g, unknown, or other
ctggagctccccgcggtggcggccgctctagaactagtggatcccccgggctgcaggaattcgtctcacccctagaaaaactcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcccctcccgggctgccccgcgctgtcgggagcagccngagcgctgccgcgaagctgctgctgcttccggcctctccggtgcgccgcgggcggggcgccgnctccgcgttggccgtgaaggcgcggcctgaacgggctcgaatcccgttggggggccccattttccaggcccggcttgagagcggccaagagggggcttctaaacctttgccaaaaaangggtagccccggggggaaaccccccccggcgccgggggaagaaaacccgggcaaaatttcggggggggggccaaaaaaaaaagggcggttgggtgctgcgtttctttccccagaagccccccaaaggaggttttccaaaagggggccaaggaaaaggggtctccaccaaaatttttttggggcgcccccccccccccggaattgttgcccccaatctctctttcaaaaaaatttgttaaaggggggggaaaaatttctcttttttcaaaaaaaaaaaggggggaaaaaaacccttggggaggacaaaaaattattatccccgccccccttttttaaatccctcccccaaaaaaattttggggccggcccccccaaaaaaagaaaacccccagaaaagcgccccgcctttttaaaaagaaagcagggggtggagaccccctcttaaagaaagggtttt

SEQ ID NO: 87838 - DNA, 893 bp, Zea mays
  misc_feature: Ceres CLONE 1574982
  misc_feature: Encodes the peptide sequence at SEQ ID NO. 87839
  misc_feature (433)..(433): n is a, c, t, g, unknown, or other
ctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaatcaactcgtcngctacatgtccgaacccatggccagcagatgaacctatctctgcacagcacccatcaagtatcaggtcggccaactactctggcgaactacatcttactggggcaaagggcagcattccggctgcaggtcatcaaacaagggctccggattttctccttccgccctcttttcccgggggggctcagaaaagttaatttctttttgggcggaatacccgcccgggaacccaaccccaaaggggctttgggctcccccccacctctttggttttccttggccccccctgttgccaccaaaaggcgtaatcccggggtgtttgaaaccccttatttttttattaataaccccagggggcccccctgttttcccccccccccgggggagagggaggcaccccccccaccacaaattatacggggtgtaagtgtgtgaaaccgggggtttccccccctcttggta

SEQ ID NO: 87839 - protein, 237 aa, Zea mays
  misc_feature: Ceres CLONE 1574982
  misc_feature (94)..(94): Xaa is any aa, unknown, or other
MAVALLAALVASAAMFMLAGTASASPAEGIQPLSKIAVHRATVEMQPSAYVRATPSLLGEQGEDTEWVTVKFGWKEPSEDDWIGVFSPSESTRXLHVRTHGQQMNLSLHSTHQVSGRPTTLANYILLGQRAAFRLQVIKQGLRIFSFRPLFPGGLRKVNFFLGGIPAREPNPKGALGSPPPLWFSLAPPVATKRRNPGVFETPYFFINNPRGPPCFPPPPGEREAPPPPQIIRGVSV

SEQ ID NO: 87840 - DNA, 851 bp, Zea mays
  misc_feature: Ceres CLONE 1574983
  misc_feature: Translation starting site: 161
  misc_feature: SWISSPROT Homolog: EC 2.7.1.90 Diphosphate--fructose-6-phosphate 1-phosphotransferase
  misc_feature (771)..(771): n is a, c, t, g, unknown, or other
  misc_feature (803)..(803): n is a, c, t, g, unknown, or other
  misc_feature (851)..(851): n is a, c, t, g, unknown, or other
caaagctggagctccccgcggtggcggccgctctagaactagtggatcccccgggctgcaggaattcgtctcacccctagaaaaaattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaggtagcaccttgcttggattcaagggaggccctgctgggatcatgaagtgcaaatatgtggaactcacttcagactttgtgtatccctacagaaaccagggcggattcgatatgatctgcagtggaagggacaagattgaaacaccggagcagttcaagcaagctgaagacacagccaacaagcttgatttggatggacttgttgtcatttgatggtgatgattcaaacaccaatgcctgccnttcttgtgaaatacttaggtcaaggaacctgnaagactcgtgtattggttgcccaagacctatcgatggagatctgaaan

SEQ ID NO: 87841 - DNA, 865 bp, Zea mays
  misc_feature: Ceres CLONE 1574985
  misc_feature: Translation starting site: 229
  misc_feature (436)..(436): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
caaagctggagctccccgcggtggcggccgctctagaactagtggatcccccgggctgcaggaattcgtctcacccctagaaaaaccagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgnggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgccccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 87842 - DNA, 841 bp, Zea mays
  misc_feature: Ceres CLONE 1574987
  misc_feature (403)..(403): n is a, c, t, g, unknown, or other
aaaagctggagctccccgcggtggcggccgctctagaactagtggatcccccgggctgcaggaattcgtctcacccctagaaaaatgcacagcctgggctctcatcactgattgcccacctattaccttcctcttttgcgatttagaatcacccatatatctacctgctctcggtcctctgtgaactctctcgtcttctaggtttcccaggcctcaagataggcctctggaccaaagcttgaaagcagctgctgttcttgcctctttttttaattcttcatttcgtggttcctggatttttgggttcttaggtttcttgtatcttcccccaaccttgcaaaatcttgtggtgaagtttcttgcgttcgctgtttcggggacatgggacgaaaggattccgccnccctccctcttgcaatactcgcagtcccctgctcattcttccccccatccctcattctatgaggtattctcctctgaaagaaaagggggaggttgctcttgatttttttttatttcttttggcaccattgttccccccggttgttcttgggggatttttgttttgtttttgaaaccggcccctcccggaatccttccgaaggaacccaaaaattttatgccgccgggggaaaatttcgccttaaatttcaaaatttccgggatgccctggtttccccctttaataaatgcccccccaatttgttttgggaagaagtggtatcttttatattccaagggggatttctttttttgtaagagcccccccaaaaaaaaaattttttaaagggcggggcccaaaaaaagagagaactttttatggggtttacaccccccccgg

SEQ ID NO: 87843 - DNA, 979 bp, Zea mays
  misc_feature: Ceres CLONE 1574988
  misc_feature: Encodes the peptide sequence at SEQ ID NO. 87844
  misc_feature (319)..(319): n is a, c, t, g, unknown, or other
  misc_feature (342)..(342): n is a, c, t, g, unknown, or other
  misc_feature (360)..(360): n is a, c, t, g, unknown, or other
  misc_feature (386)..(386): n is a, c, t, g, unknown, or other
  misc_feature (401)..(401): n is a, c, t, g, unknown, or other
  misc_feature (494)..(494): n is a, c, t, g, unknown, or other
  misc_feature (518)..(518): n is a, c, t, g, unknown, or other
  misc_feature (519)..(519): n is a, c, t, g, unknown, or other
  misc_feature (545)..(545): n is a, c, t, g, unknown, or other
  misc_feature (555)..(555): n is a, c, t, g, unknown, or other
  misc_feature (556)..(556): n is a, c, t, g, unknown, or other
  misc_feature (571)..(571): n is a, c, t, g, unknown, or other
  misc_feature (572)..(572): n is a, c, t, g, unknown, or other
  misc_feature (583)..(583): n is a, c, t, g, unknown, or other
  misc_feature (584)..(584): n is a, c, t, g, unknown, or other
  misc_feature (600)..(600): n is a, c, t, g, unknown, or other
  misc_feature (601)..(601): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
ctggagctccccgcggtggcggccgctctagaactagtggatcccccgggctgcaggaattcgtctcacccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcgngcggtgcggatgcgcgcgccctnctcgcggggtccgcgggnggctccgcgtctgcgggtcacgtgcngagaaggtggtgggngaatcgacctaggcaccacctaactcctgcggtcgcctgcctatggagggggcggcaagctgacctgtcgtcacctaacgcctgaagggcgtncgcgcacaactcctctcctgtagnntggcgtacaccaagaacaggggagtncgcctggtgnngggcagatctgctannagcgccaggcnnggtcgtgaacctccgnnagaacaccttcttctctgtcaagcgcttcatcggccgcaagatgtctgaggtcgacgacgaggccaagcaggtctcgtacggcgttgtcaaacagaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87844 - protein, 20 aa, Zea mays
  misc_feature: Ceres CLONE 1574988
MSEVDDEAKQVSYGVVKQRG

SEQ ID NO: 87845 - DNA, 966 bp, Zea mays
  misc_feature: Ceres CLONE 1574991
  misc_feature: Encodes the peptide sequence at SEQ ID NO. 87846
  misc_feature (793)..(793): n is a, c, t, g, unknown, or other
  misc_feature (872)..(872): n is a, c, t, g, unknown, or other
ggagctccccgcggtggcggccgctctagaactagtggatcccccgggctgcaggaattcgtctcacccctagaaaaaaccgggcagagcggaggggtgccggtgtccggactccggagagaatggcggccactcttctcccgaccttatcgccgcccgtttcgcgcgccgccgccgctttcctcctccgacgagccccactgaagccctcccattatgtgcacccaccttctactctccgccgcttactcatctcctcctatccagcaatccctgccatgtgccccctctccaccatgtcgtccaccactgccgctcgcgccgtcccggtccgccgtgacctcctcatgctcggcatcgagaccagctgcgacgacactgcggctgctgtggtgagaggtgatggcgagatccttagtcaagtagtatcttcccaagcggatttgctcgcgaggtatggtggtgttgcccctaagatggccgaggaagcacacgcccttgtgattgaccaggttgttcaaaaggctcttgacgatgcaaaattgtcagaaagtgatctttctgcagtcgctgtgaccattggaccaggacttagtctatgccttagagttggtgttcataaagctagacaggtagcaaaagcatttggcttgcctattgttggagttcatcatatggaagcacacgcattagtttccaggctagcgaataaggaccttgatttcccatttctggctcttctaatttccggaggaacaaccttcttgttctcgctcatgggtctgggcattancattcactggggactactatagatgatgcgattggtgaggcatatgacaaatcaccaggaggtttgggcctgatatgcngaaaagtggtgtcctgctctttgagagcttgctctaaaagtgatccaatgccggtaaagtcaaagttcaatgcgacgcattaagattgcaattt

SEQ ID NO: 87846 - protein, 172 aa, Zea mays
  misc_feature: Ceres CLONE 1574991
  misc_feature (38)..(169): Pfam Name: Peptidase_M22 Pfam Description: Glycoprotease family
  misc_feature: SWISSPROT Homolog: EC 3.4.24.57 O-sialoglycoprotein endopeptidase
  misc_feature (166)..(166): Xaa is any aa, unknown, or other
MSSTTAARAVPVRRDLLMLGIETSCDDTAAAVVRGDGEILSQVVSSQADLLARYGGVAPKMAEEAHALVIDQVVQKALDDAKLSESDLSAVAVTIGPGLSLCLRVGVHKARQVAKAFGLPIVGVHHMEAHALVSRLANKDLDFPFLALLISGGTTFLFSLMGLGIXIHWGLL

SEQ ID NO: 87847 - DNA, 941 bp, Zea mays
  misc_feature: Ceres CLONE 1574993
ctccccgcggtggcggccgctctagaactagtggatcccccgggctgcaggaattcgtctcacccctagaaaaatgagtctaaactgttacagcttgtcaatcctgcctatcaatctcttctaggtcacttacacactagaactttagaagcatttaaggagtactttggcaaggccctagaaaaggagggatttgctgttgcagcttgcaattgtactgaaactttcttggagaagtttgatagaggatctgaagatgctgctattcaacaagtgaattgggacacctcaaaagtgagggataagcttagacgtgacattgaggctcatgtagcttcagttcgggctgctaaattgtctgaactttgtgcgaaatatgaggcacaacttaccaaagctctcgcggaaccagttgaatctcttctagattcagccagggaagacacgtggccagctattagaaagcttcttcaacgcgagacaaaaactgctgttttaggtcttgaatctgctgtgtcagcttttgaactcgatgaagcaactgagaaaaaactgcttgcgaagctggagaaacatggaacgagtgttgtttagtctaaggcaaaagaaaaagctggaaggggttttattcccatgaaagaaagggtctcaaccttggtcaaccgaaaatgctgaatcttagcccagggtgtgggcctggaaagggggacctaaaagcctttactaaaaccgcctccctcagcctttcgtggaagttggttttcacaaagggcgtggcattcccgttggggggaggaggggggaaaaacatggagaaaaacccttttccctgtggcttggtggaaacattccagaacagcggaatatccaaacggagggaccctacttgtccgaccccctttgtcctccacttcttttgaaaagagcctcttatggaataa

SEQ ID NO: 87848 - DNA, 887 bp, Zea mays
  misc_feature: Ceres CLONE 1574996
  misc_feature: Translation starting site: 176
  misc_feature: SWISSPROT Homolog: EC 4.3.1.5 Phenylalanine ammonia-lyase
ctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctactgcgtcaccacgggcttctgcggcacctcccaccgtcgcatcaatgtaggggcccgcgctcccagtcgagctgctcaagcatctcaacgcgggaatctcggcacggcagcgacgggacacgctgccgtcggaagtacccgcgccgcgatgctggtggcatcaacaccttctccagggctactccgggattccgctcgaagaaccccgagccatcacctagctgctcaaaaccggtggtaagccccgggctggccgttcggggaaacaatacccgggtggggggaacctgggccccttctctaaatatggcgggcttattaagggggccccacaaagcgaagggcggaccccctcaaagaaaaaaaaggggggaccccccctagaggtttaaaaaaacccccggccctaaggggggggtcctcta

SEQ ID NO: 87849 - DNA, 703 bp, Zea mays
  misc_feature: Ceres CLONE 1574997
  misc_feature: Encodes the peptide sequence at SEQ ID NO. 87850
  misc_feature (477)..(477): n is a, c, t, g, unknown, or other
  misc_feature (493)..(493): n is a, c, t, g, unknown, or other
aaagctggagctccccgcggtggcggccgctctagaactagtggatcccccgggctgcaggaattcgtctcacccctagaaaaagcgacgtgcgcgtgccgctgtgctgcactgctagtgttccttcgcgccgtgctgtccggcccgcccgcgccgcgcaccgatgccgccaccgtcttcctcgcgctactccccgggccggctgctcgccgcgcgcccggcgtccgccaccacggtggggagatgggcgcgcttgtcgtgctcgctgtccatgaacgggtgcgcgccgggcgccggggaccgcggcgcggtgtgcgtgcgcgagacgcgggcgctgccggccgcgccggcgccgcacgacgcagtggggcggctcagggccgccgtggacgcgctctggtccaacgcagcgccaccggccgcgccctccggcatcatccgcatcgaggtgcccatcacgcagcgggtggacgcccntgggaaatgctgcagnccagacaagctgcccgctggttctttggcccggggccgtgcccgaacggccgcctttgcgggaacgggaaggggaaaggatggtccaattgaaaaaacccggggaattgtcccgggcgtggggtttggggggggtttctttcccaaggggggaaggaacccccctttttttccaaacataaaatggggcgcccccaaaaaaaaaagaaaa

SEQ ID NO: 87850 - protein, 180 aa, Zea mays
  misc_feature: Ceres CLONE 1574997
  misc_feature: SWISSPROT Homolog: EC 5.4.4.2 Isochorismate synthase
  misc_feature (105)..(105): Xaa is any aa, unknown, or other
  misc_feature (110)..(110): Xaa is any aa, unknown, or other
MPPPSSSRYSPGRLLAARPASATTVGRWARLSCSLSMNGCAPGAGDRGAVCVRETRALPAAPAPHDAVGRLRAAVDALWSNAAPPAAPSGIIRIEVPITQRVDAXGKCCXPDKLPAGSLARGRARTAAFAGTGRGKDGPIEKTRGIVPGVGFGGGFFPKGGRNPPFFPNIKWGAPKKKRK

SEQ ID NO: 87851 - DNA, 915 bp, Zea mays
  misc_feature: Ceres CLONE 1574998
  misc_feature: Encodes the peptide sequence at SEQ ID NO. 87852
acccgcggtggcggccgctctagaactagtggatcccccgggctgcaggaattcgtctcacccctagaaaaagatctccctctctctcgttctgctcacatcgacgcggttcggttccagtttcactcccactgccgtctcggcaacctcccctgttccacgcttcgtcctcgcgttcccaaccaagctctcccgcctgccatggccgcgacctcccccttcgactgcgtcctcctagacctcgacgacaccctgtacccgggcgacacgggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcgcctgctgcagagcatcccgcagcgcatagtgctgttcaccaactcggaacgcgcgcacatgtagcgggcgctggagctgctgggcgtggactagccgccttcgacgccgtcgtgtgcttcgagaccatgacccgcacctgttcggcgacggctgttgcgaccggcgcccggccgtgtggctaaaaccgcggtggaaccaatcttccccgggttgcgcgccccgggtccaaccaaagccggaagctgttctggacaaaacaaaaagaaactccccccggggaaaaagctcggccccccaacacccctggttggaaaaaggcgaaggaccaagaaaccgaatcccccgtgaaaaaaatcgggcgcccccgggggccttcccggaatttggggggaagccctataaccctcccacaaaaaa

SEQ ID NO: 87852 - protein, 119 aa, Zea mays
  misc_feature: Ceres CLONE 1574998
MAATSPFDCVLLDLDDTLYPGDTGIGAALRRNIDEFLQAKLGVSADEAAATRAELFRAHGSSLAGLIALGYDVHPDEYHSYVHGRLPYDRIARDPQLARLLQSIPQRIVLFTNSERAHM

SEQ ID NO: 87853 - DNA, 928 bp, Zea mays
  misc_feature: Ceres CLONE 1575001
  misc_feature: Encodes the peptide sequence at SEQ ID NO. 87854
  misc_feature (403)..(403): n is a, c, t, g, unknown, or other
  misc_feature (406)..(406): n is a, c, t, g, unknown, or other
  misc_feature (543)..(543): n is a, c, t, g, unknown, or other
  misc_feature (544)..(544): n is a, c, t, g, unknown, or other
tggagctcaccgcggtggcggccgctctagaatagtggatcccccgggctgcaggaattcgtctcacccctagaaaaagcaccctatcctcctcctccccggtccggcggtccccaccggtccaccacggcaccaccgtctccccgccccccgcgtccgatcaccgcaccggcgaactcggcgagccgctcgtcgctgcacgctaagctgggaatggccgctgcgctcgccagctcaccgcttgttcacctatccacctcccgcctccgcctccccaggccccgggcctcctccagttccgctccaggctgctcgatcggcgtgtgcttgggatggaggctgaaggtcgggtggagggctctgaggcggtgcgaccggcttcgatgcttctccaccgacggcnacngcgtggaggtaggggagaagcgtggcgaggaggaggcctcggcgacggcggccccggccccggacccagccccagcggagacacaggtgggcgctgcggaggagctggcgtctgagcggagccgatcagggagcttnntcgtctcatcctcgtccgggaatcctggtgtatcaagcgagccaccactggtgagttttagtgttgataatatcgatacagttaaactattggaacttctaggcccggaaaaggttgacccagttgatgtcatggcaatttaagaaaaaactccttgggtatacgacaatctggttgacaaaagaaaagccctttgggtgatctccggggaaacgagccttttcttgggggaatctccctggggaaagaggggagaaaatctttggcaaaaattccaaagcgaacttcgcgggaaactgtgcgggggaaaaataaaaatcttttttttgggggagagggaacccatttctcaaaggggggatgacccaaccggggggggaaccc

SEQ ID NO: 87854 - protein, 157 aa, Zea mays
  misc_feature: Ceres CLONE 1575001
  misc_feature (64)..(64): Xaa is any aa, unknown, or other
  misc_feature (65)..(65): Xaa is any aa, unknown, or other
  misc_feature (110)..(110): Xaa is any aa, unknown, or other
  misc_feature (111)..(111): Xaa is any aa, unknown, or other
MAAALASSPLVHLSTSRLRLPRPRASSSSAPGCSIGVCLGWRLKVGWRALRRCDRLRCFSTDGXXVEVGEKRGEEEASATAAPAPDPAPAETQVGAAEELASERSRSGSXXVSSSSGNPGVSSEPPLVSFSVDNIDTVKLLELLGPEKVDPVDVMAI

SEQ ID NO: 87855 - DNA, 1024 bp, Zea mays
  misc_feature: Ceres CLONE 1575002
  misc_feature: Encodes the peptide sequence at SEQ ID NO. 87856
  misc_feature (813)..(813): n is a, c, t, g, unknown, or other
  misc_feature (1024)..(1024): n is a, c, t, g, unknown, or other
ggagctccccgcggtggcggccgctctagaactagtggatcccccgggctgcaggaattcgtctcacccctagaaaaagcgctgggttggtgggggcgcaccgcagtccgcaccggacctcgagaggggaggagaggagatgggaggggtcaacgaggtgggagcagacaggaaggctcggggctccttcctcctataaacccaccgcacctgccttagaggctcccattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccaccccagcttcttcatcgatggcaagcagcatggcaaggaatgctgaccctaaacaacagactctccgccccaatttaatggagaagttctatttttcaagaactgggtcatccttggcaaggcattcctccatttttttggggcccccccccaggttggaatcctcctaaggacaatgaaagctaaattttgggaaaccaactttgaattaaaatcctctccccaaaaaaaaagattgggaaccccccggggcaataaggggggcaacccttatcctttccttttagaccaaggatatcaccccgggtaaaaggatttttgtggcggcccctcggggtaccccggaaaaaccccagtcgcgtgggggggtcccggtggggggagtgttaaaaaaaaactctcttataccccnggcctcccctgatgtttttattacccgctcttttttcgcggtgggggggtgccccccttcataaaaaaaacactctctttgtaagaaaccccgcgtgcgggcggcttggccacccttgtggttctccccagggttttttttgtatattactctcccccaacgtgaaagacaaggatttttttccacaagatataatttttttgtaggggan

SEQ ID NO: 87856 - protein, 67 aa, Zea mays
  misc_feature: Ceres CLONE 1575002
MEGGMSSLEAATPASSSMASSMARNADPKQQTLRPNLMEKFYFSRTGSSLARHSSIFLGPPPRLESS

SEQ ID NO: 87857 - DNA, 900 bp, Zea mays
  misc_feature: Ceres CLONE 1575006
  misc_feature: Encodes the peptide sequence at SEQ ID NO. 87858
ctggagctccccgcggtggcggccgctctagaactagtggatcccccgggctgcaggaattcgtctcacccctagaaaaaagccgccgccgtcgaccagagcactcccccgtcgtcgcctcgatgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtggtcccatgtcggcgacctcgacgactccgctgcgggccgctccgtgcttatccgcggagccgcgcaggccatccgtccggtcagcaagaagatggctttcgtcgtgctgcgccagagtatgagcaccgtgcattgcgtgctcgtcggcagcgccgaagccggcgtcagcacgcagatggggcgcttcgccacccgccctcagaaggaatccatcgtccaactttgaaggcggtcctcctccccccccaaaggagcccccttagggcccccccccggcaggggtgggatcccaggggagggaaagacccattggcctcaaaaggggggttttcccaacccctcccaatttaaccttggaaaattccggcccccgaaaaggggggaaaaattttgaaaaaaggggcgaaattggggggggaaaaaaaaacttggtttccccgtttggcgccaaaaaaacccccccttggggaatacacacaaaggcttttttgttgtttttcaaaaaaaacccccgcggataacaacaggca

SEQ ID NO: 87858 - protein, 157 aa, Zea mays
  misc_feature: Ceres CLONE 1575006
  misc_feature: SWISSPROT Homolog: EC 6.1.1.12 Aspartate--tRNA ligase
MSSEPPPASSAAAGEELAADLSAATLSKKQQKKDARKAEKAEQRQRQQQQQQQPADAEDPFAANYGEVPVEEIQSKAISGRSWSHVGDLDDSAAGRSVLIRGAAQAIRPVSKKMAFVVLRQSMSTVHCVLVGSAEAGVSTQMGRFATRPQKESIVQL

SEQ ID NO: 87859 - DNA, 863 bp, Zea mays
  misc_feature: Ceres CLONE 1575007
  misc_feature: Encodes the peptide sequence at SEQ ID NO. 87860
  misc_feature (635)..(635): n is a, c, t, g, unknown, or other
  misc_feature (645)..(645): n is a, c, t, g, unknown, or other
  misc_feature (647)..(647): n is a, c, t, g, unknown, or other
aagctggagctccccgcggtggcggccgctctagaactagtggatcccccgggctgcaggaattcgtctcacccctagaaaaaatcactgcactggtggtgtccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccacccaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttcccttactgataaggaagttctgggtgaaggggacactgcaaagcttgagattcagattaagttggacaaagagaagaaaatcctctccattcgggatagggggtattggtatgaccaaggnaagatcttantnagaacctttggaacgattgctaaatctggcactttcagcttttgtggaaaagatgcaagtctgggaggtgactttcatcttattgggacaggttggtggtggccttctacctctggggacttggggtggcgaacaaggttggaagtgggtccgccaagccccatggatgattaaacaggtatgtggtgggaatccaaaaccttgatggaatcattt

SEQ ID NO: 87860 - protein, 224 aa, Zea mays
  misc_feature: Ceres CLONE 1575007
  misc_feature (167)..(167): Xaa is any aa, unknown, or other
MRKWALSSALLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGYWYDQGKILXRTFGTIAKSGTFSFCGKDASLGGDFHLIGTGWWWPSTSGDLGWRTRLEVGPPSPMDD

SEQ ID NO: 87861 - DNA, 869 bp, Zea mays
  misc_feature: Ceres CLONE 1575008
  misc_feature: Translation starting site: 417
  misc_feature: SWISSPROT Homolog: EC 2.7.7.27 Glucose-1-phosphate adenylyltransferase
  misc_feature (365)..(365): n is a, c, t, g, unknown, or other
tggagctccccgcggtggcggccgctctagaactagtggatcccccgggctgcaggaattcgtctcacccctagaaaaaatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgtagttcagcagcgtgcttcccctagagggaaaagcgtgtatgagcccagtgaggagaggcagtggaggttatgggagtgagaanggatgaggatcaactgctgcagcatcaggcgcaacaaggcactgagggaggatgtgtttcagtgcaaaggggtgctgtgagcagcaacgcagtgtgtgctcacatcagatgctggcccagacactcttgtcgtccgaaacatcctttcggaagaattatgctgatccctaatgaagtcgctgccgtcatttttggggtggtggtaccggggactcagctttttccctctcacaagcacaaagggccacccctgcctgtccctatttggaagatggttacaggcttaatggatatccccatggagcaactgttttccaacagtggcataaacaaagataattggttatgaactcaatttaaaatcaagctttctcttaaaccggcccattcttcggaccctatctggggggggggggaaaccaactccccccgaaggaaacctttttaaaggggccgggctccaaaccaaaaatgccctggggaagagctccctggttggttccc

SEQ ID NO: 87862 - DNA, 797 bp, Zea mays
  misc_feature: Ceres CLONE 1575011
  misc_feature: Translation starting site: 327
aagctggagctccccgcggtggcggccgctctagaactagtggatcccccgggctgcaggaattcgtctcacccctagaaaaaagcagtacccactcacgagaccgtccaggcgtccaccgcgacgcgctctcctgcccgtgcccacctccacgactccacctccgcagcgcccgcggtaacctccccacgccacgccacatcgcgtgcgagccccaaccgtcgccggcctcccaattaagccgcccccgcggcgcgatccggtgtccaccgctgctccgccggaggaggtggaaggggaagaaaagggagggggaacacagggggatgctagaggcgaagccgccgtcgccgggctccggcgcggccggggcggcggcgcacatccacggtcaccggcggtgggcggcgccgctgctggcctcggtcctgctctcgtcgctcctcatcaccgcgtcgctcttcttttcctcctcccgcgcgctgctactctccttctcgccgctcccctccgcggcctccgccgagcctctcttcgtggaggccaagctccgccagcagatgcgggccgaggagcgccccacgcggggcgccgtgcccaggatcgcctacctcatctccggctccgcggggggacggagccgcgctgcgccggacgctcagggcgctctaccacccggtaacacatacgtcgtgcatctcgacctcgaggcccccgccgccgagcgcgccgaactcgcctctgccatccacgcggacccgttctacgctaggttccgcaacgtcaagttcgtcaac

SEQ ID NO: 87863 - DNA, 941 bp, Zea mays
  misc_feature: Ceres CLONE 1575012
  misc_feature: Encodes the peptide sequence at SEQ ID NO. 87864
  misc_feature (682)..(682): n is a, c, t, g, unknown, or other
  misc_feature (688)..(688): n is a, c, t, g, unknown, or other
  misc_feature (892)..(892): n is a, c, t, g, unknown, or other
  misc_feature (941)..(941): n is a, c, t, g, unknown, or other
ctggagctcaccgcggtggcggccgctctagaactagtggatcccccgggctgcaggaattcgtctcacccctagaaaaatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaacaagttcggctcctgtcgtcacgcgaccgcggtccactcgcaggggcagtgaccgtgctgctgccggcgacngcgacngcgaggatcctggggtcgcggcatggcgagcgagagatctcgacgaagcatctcgtcgctgttcctgttcccactgcaacgctaccgaaagactttgaagcggggcgtcgccgctgcgacatgatggtggcgagcgcgcgacgttcccgtcgtcaagcggcgaatgagcgccgcatgtgggaacacacggcgtggcaacgaccnaagctgcgggggctcaggcccgctggagtggcttccgccgccgtcagan

SEQ ID NO: 87864 - protein, 212 aa, Zea mays
  misc_feature: Ceres CLONE 1575012
  misc_feature: SWISSPROT Homolog: EC 3.2.2.22 rRNA N-glycosylase
  misc_feature (179)..(179): Xaa is any aa, unknown, or other
  misc_feature (181)..(181): Xaa is any aa, unknown, or other
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVVTRPRSTRRGSDRAAAGDXDXEDPGVAAWRARDLDEASRRCSCSHCNATERL

SEQ ID NO: 87865 - DNA, 826 bp, Zea mays
  misc_feature: Ceres CLONE 1575013
  misc_feature (789)..(789): n is a, c, t, g, unknown, or other
ctggagctccccgcggtggcggccgctctagaatagtggatcccccgggctgcaggaattcgtctcacccctagaaaaagtacacagaacggcaaacgggttcatgcacgaatctccagtcttgagtactcgaccttgctgccttcttcgtcggccggctcgcccgcgagcagcccggcgcggacatcctcgaggtcggcggcgtcggcgtcatcaggcgccgtggctggtccgtgggagctgtcagcgggcggcacgggcgccaagaactcggcccacgggcgcctcttggcctgctccacgacgtagtacagcgcgacgccggcgacgaccacggcggcgttgatgaggacggtcctggccgacgctaggcacatgacggtggcgatgagcacggcgggcggggcgcacatggcggcggcccccgcggtgccgacggggacccggtacggccgcgccaggtccgggttcttcacgcgcagcttcacgaaggcagcgaacacggccagcatgcccagcccgtagaggaagttgaggaactcgatgatctcctggaagctcatgaaggacaggatcacaaccccggtcgccgagcacaggatgctgaacgtcggcgtcccgtacttggacctgcgttcatcagcaccagttcacaaaaaagattcagtttttcgttcgattgaaagctgcctctgcacactgattctttcacgtcggagccgcagacttcacctgcgagcgaagatggcagggatcatgcccatctcggccatgccgagaagctggaangagtcgctgctcatctcggcctcgaagagcaccatgt

SEQ ID NO: 87866 - DNA, 1153 bp, Zea mays
  misc_feature: Ceres CLONE 1575014
  misc_feature (910)..(910): n is a, c, t, g, unknown, or other
  misc_feature (1015)..(1015): n is a, c, t, g, unknown, or other
  misc_feature (1101)..(1101): n is a, c, t, g, unknown, or other
  misc_feature (1103)..(1103): n is a, c, t, g, unknown, or other
  misc_feature (1105)..(1105): n is a, c, t, g, unknown, or other
aaagctggagctcaccgcggtggcggccgctctagaactagtggatcccccgggctgcaggaattcgtctcacccctttaactaaaacataatccgccaccagccttgctccctcccagaaagtaccgaaggctacctgaaggagctctcacctcacatgcatctctgtcgcgcccgtcatgctcctcctacctcccttctcaactcccatcggatttcccctgcaccgggaggtccaccccgggctggggaagttgtttcccgcggctaggaacccctaatcttggaggccattcgtatttttcagtccgtcgcacgaagccccccccaaagattcggattgcgacccttagttcggggacctgcctaggtggttgtggtcgtgatattggggttggaaaccccccctgggcgggggtgtcacctgcgtggggggggtgtagcgcctttgtattttaacccccccccctgttagaataatttttttggaacaagcaccccgcgggcagtggagaatttgtgacaacctcccctccctagtttccattacgactttgaccttgcccccgtcgtgcaattccctaattgaatactcaggtaggtcgatccctccatcgttcgtcactttttgtctttcgtgaacctcctcgcgggcagaggagtcaattgatcaacaaggcccctcctgatgttgtgagtctttttcctgtggggcttttcgggagccgcggtgtggttccccgttgccgccgcttacataattattggcggggggcgcctcgtgttccccctctttttccacaacattataaagctgtgttctgtaggggtgggacgactttttccccgctctgctttttgttcgcgccccgtgggagggtgtgtccaaattcacgtgtgttatttgttntttatcgctatctcgtccgtcgtgtgtcggtgcttacgcagcctctcattctccatgcttccccgtatcattctatcttttaggatttttagtctcaatctcccnttccttctcttcttctctattctcttctagcgctcacgtgtgccaatcttggagagttgtaatggcctcgccgctggcgccgcgcntncntctgtcttctaacgctttgactccgtatcctttgtcgcgccgtctctt

SEQ ID NO: 87867 - DNA, 894 bp, Zea mays
  misc_feature: Ceres CLONE 1575017
  misc_feature: Translation starting site: 341
  misc_feature: SWISSPROT Homolog: EC 2.7.11.24 Mitogen-activated protein kinase
aagctggagctccccgcggtggcggccgctctagaactagtggatcccccgggctgcaggaattcgtctcacccctagaaaaaatcgttttccgttctccaatccgtcaatccagtccccatccccacggcgccgacgactcgggggctcccccccttggacttggcccgggtgggagtagcacgtcggggaagggaagcaagcgtccgcgagtaaggacagaaaaccgaagggaggagtggagaggaggagcttgcttggagcgggtggacgggtggtgtgtatatagttaagcgggcgggcgggcagccaatgccgtcgggcgcgcagggctaggagcatgggcggagggggcgcgatcgtgcacggcttccgccgctggttccaccgccggagcgaaggctccacctccaactccaaccagtcgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattggtaaaggggagctacggagtagttgctgcagctgtggacacccgcaccggtgagcgggttgctatcaagaagatcaatgatgtgttttgagcacgtctcggatgccacacgcatactgcgggaagatcaagctcctccgggttgctttctcacccggaccttagtcgagaattaagccacatccttgcctccctccctttctgcggaggggaggttccacagaacattctaatgtttgttttttttgagccttcaatggagg

SEQ ID NO: 87868 - DNA, 894 bp, Zea mays
  misc_feature: Ceres CLONE 1575020
  misc_feature: Encodes the peptide sequence at SEQ ID NO. 87869
ctccccgcggtggcggccgctctagaactagtggatcccccgggctgcaggaattcgtctcacccctagaaaaagagctcagacacatattaagaacgcaagaaagaaaagactgtagctagctagccaccgcgcacgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcgtgagcctcgtccccaccgtgcaccaccgggccggcgggttccccagcagtgtggcactgacgaacacacttcagcgccgtcgtcgttcaccccgctatattgtcgtcgcgcttgcgactacaaccgaacacgaggccgcccctgtgacgatccaagacgtggacctcagctctcatcacgccgcggtgcgacgatcgggagctcaccgcgcagcggccgggaggcccacttgcaacaacaactgggtagggtctgactggacccccattagacaggcgtgcctcctccaaggagactaaatccccctaacgggcctaggttccaccccagggccaaccttaggggacagagctttctaaactaacgagccggccttttcttcccccctaacaggcgggcaggccgcaaaagttaccccgggccaaaaaaaccttttttttcccaccaacggttccgggcctttcgggcggggcatcggggttacagaagggtcgggcctgggtaaccttgttaaacccccaaccttgtagaacgaaacctttcaaggttttcccccaacactttccggcgattcaaaagaaccgggccgccactcacaagccaaaaagaattatcggaaacccaa

SEQ ID NO: 87869 - protein, 107 aa, Zea mays
  misc_feature: Ceres CLONE 1575020
MAATVSSCVSLVPTVHHRAGGFPSSVALTNTLQRRRRSPRYIVVALATTTEHEAAPVTIQDVDLSSHHAAVRRSGAHRAAAGRPTCNNNWVGSDWTPIRQACLLQGD

SEQ ID NO: 87870 - DNA, 922 bp, Zea mays
  misc_feature: Ceres CLONE 1575024
  misc_feature: Encodes the peptide sequence at SEQ ID NO. 87871
  misc_feature (361)..(361): n is a, c, t, g, unknown, or other
  misc_feature (362)..(362): n is a, c, t, g, unknown, or other
  misc_feature (922)..(922): n is a, c, t, g, unknown, or other
tccccgcggtggcggccgctctagaactagtggatcccccgggctgcaggaattcgtctcacccctagaaaaatggtcgcttccacgctggcctaccttttccttccctactcacaattcccaaccctggatccggatctcaaggcgttcccagaaccgaaaacgacgcgcgcaagccattattagctggctagctaggcctgtattctccgaaatcatgaagcgcgagtacctgagacaccggctggagtggtagcgacatgggctcctctccggagaagatgatggccgcgacacggggaggtggggaacatgaggaggaggacctggatgatctgatagccgcacgcgggtacaaggnnaaaacgttagatataagcaacttcacggccaaactggagcagctaaccatggccatgcccatggccggcgtgggcggcgccggcgctaccgctgatgacgggttcgtgtcccacttcggcaccgacaccgtgcactacaatccctccgacctgtcgtcctgggtcgagagcatgctgtccgagctcaacgctcccccagcgccgctcccgcccgcgaagccggccccaaggctgcgcgtcacatcgtccaccgtcacaagtggcgccgccgcccgggtctggctacttcaatctcccgcccgccgtggactcgtccaacagtacctacgctctgaagccgatccccttccccggtggcggccccctccgcccgaccggtccacgaaatcgggggcggggaccccaagccggaaaaaaggacagccgggctggaacacacgacgacccgcccgcataccctcgtctctccatccaatgggaggggcgggctccgcaattaggaaggctcccggttggcccaaaaagtaggcccccccccagggtaatactatagacttttn

SEQ ID NO: 87871 - protein, 209 aa, Zea mays
  misc_feature: Ceres CLONE 1575024
  misc_feature (34)..(34): Xaa is any aa, unknown, or other
MGSSPEKMMAATRGGGEHEEEDLDDLIAARGYKXKTLDISNFTAKLEQLTMAMPMAGVGGAGATADDGFVSHFGTDTVHYNPSDLSSWVESMLSELNAPPAPLPPAKPAPRLRVTSSTVTSGAAARVWLLQSPARRGLVQQYLRSEADPLPRWRPPPPDRSTKSGAGTPSRKKGQPGWNTRRPARIPSSLHPMGGAGSAIRKAPGWPKK

SEQ ID NO: 87872 - DNA, 874 bp, Zea mays
  misc_feature: Ceres CLONE 1575027
aaagctggagctccccgcggtggcggccgctctagaactagtggatcccccgggctgcaggaattcgtctcacccctagaaaaaagatttcccgagccgggacgtggcggcagacggcgacgttaggaagtccggagacgccggcgggggcctcgggaagagttatcttttctgcttaacggcccgccaaccctggaatcggttcagccggaggtagggtccagcggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaattcggcaaaacggatccccaacttcgggaaaaggattggctctgagggttgggctcgggggtcccggccccgaacccgtcggctgctggcggaatgctcgagctgctcgcgcggcgagagcgggccgccgcgtgccggccgggggacggaccgggaacggccccctcgggggccttccccgggcgtcgaacaaccgactcagaactggtacggacaaggggaatccgactgtttaattaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcggaaccacagcccaggggaacgggcttggcggaatcagc

SEQ ID NO: 87873 - DNA, 876 bp, Zea mays
  misc_feature: Ceres CLONE 1575033
  misc_feature: Translation starting site: 101
  misc_feature: SWISSPROT Homolog: EC 2.4.1.12 Cellulose synthase (UDP-forming)
  misc_feature (738)..(738): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
aaagctggagctccccgcggtggcggccgctctagaactagtggatcccccgggctgcaggaattcgtctcacccctagaaaaacttctttgatatcaagatgaaaggtctagatggcattcaggggccagtctatgtgggaacaggatgctgtttcaataggcaggctttgtatggatatgatcctgttttgactgaagctgatctggaacctaacatagttgttaagagctgctgtggtagaatgaagataaagaacaagagttatatggatagacagaaccctattatgaagagaacataatcttcagctcccatctttaacatggaagacatccaggagggtattgaaggttatgagagatgaaaggtcaatgcttatgtcccacacgaaattggagaaaccctttggtcagtctccaatcttcattgcatccacctttatgactcacggtggcataccaccttcaacaaacccagcttctctactgaatgaagatatccatgttatcagctgtgggtaccaggacaaaactgaatggggaaaagagattggctggatctatggctcacttaccgacgatattctgacaggctttaaaatgcatgcaagaggctggcaatcaatctactgcatgccaccacgaccttgttttaagggttctgcaccaatcaatctcttctgatcgacttaatcaggtgctccgttgggctcttgcgtacaaggacatctgctanccagaccttatcctatatagaatggctacaatgggcgatatgagcttttgaaagagctcgactacatctacacattgtttatcgatcacagctgttcgcttatcggcaactgtgtgctgctgcacattannnnaaaaa

SEQ ID NO: 87874 - DNA, 903 bp, Zea mays
  misc_feature: Ceres CLONE 1575036
  misc_feature: Encodes the peptide sequence at SEQ ID NO. 87875
aaagctggagctccccgcggtggcggccgctctagaactagtggatcccccgggctgcaggaattcgtctcacccctagaaaaagagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaggagttgcatggttgattggctgggctttgatacttgaatacacgattggtggatcagccgttgcccgtggcatttctcctaatctagccttattttttggaggacaggatagtctgccatggattttagcacgacatgagatcccatggcttgatgtcgttgtagatccttgtgcttctttcctcgttttcgtcgtcactgggccttctctgtgtgggggataaaagagagttcaatttgtgccaagaggttgtgaacggtctttaaattgctttggggagggttattttgttatccatagcccgggagcttacatccggctttccaaacaaggaaggggttgggcctaccaggtattgctggggcgggatattttctccttta

SEQ ID NO: 87875 - protein, 181 aa, Zea mays
  misc_feature: Ceres CLONE 1575036
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGQDSLPWILARHEIPWLDVVVDPCASFLVFVVTGPSLCGG

SEQ ID NO: 87876 - DNA, 733 bp, Zea mays
  misc_feature: Ceres CLONE 1575037
  misc_feature (206)..(206): n is a, c, t, g, unknown, or other
  misc_feature (254)..(254): n is a, c, t, g, unknown, or other
  misc_feature (266)..(266): n is a, c, t, g, unknown, or other
  misc_feature (293)..(293): n is a, c, t, g, unknown, or other
  misc_feature (294)..(294): n is a, c, t, g, unknown, or other
  misc_feature (306)..(306): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
aaaagctggagctccaccgcggtggcgggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggangaaaagcttcagaatcctagctctcagcttcccagggtcccccctccntccccaatggcntcgccccgtagccccgcgtccgccggnncaacggttcggncaaaatggggcccgggggccccccaaaggggggggcccccgccaaaaaccgggggggcccttttggggggggggccccttggttctttccgggggtcccccccccccccccttacccgggggttttggggcccccccctttccccggggggaaaaacccccccccccccccccaaaaaaaaaaaaaaaaagggggttcccccccccccttttttttgtgggggtgggggggggtttttttttttctttttaaacaacccgggggggagagaaaaccccccccccccaaaaaaaaaagaaaggagcgcccgcccccccccctctcccgggggggggggggggaaaaaaaaaaaaaaatttttttttttttataaaccccccccggccccnnnnngnnnngtttttgtggggggggcccctctgggggg

SEQ ID NO: 87877 - DNA, 747 bp, Zea mays
  misc_feature: Ceres CLONE 1575038
  misc_feature: Encodes the peptide sequence at SEQ ID NO. 87878
  misc_feature (425)..(425): n is a, c, t, g, unknown, or other
  misc_feature (450)..(450): n is a, c, t, g, unknown, or other
  misc_feature (451)..(451): n is a, c, t, g, unknown, or other
  misc_feature (463)..(463): n is a, c, t, g, unknown, or other
  misc_feature (464)..(464): n is a, c, t, g, unknown, or other
ctggagctccccgcggtggcggccgctctagaactagtggatcccccgggctgcaggaattcgtctcacccctagaaaaaaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggggaagggctctttcgccttcctggagctcagcgacgggtcctgcgctgccacgcttcaggccatcgttgacgccgccngtgcaccgctagcgcgcctcaccgnncacgggcacctnncgtcctcgtcgaggggcgtggatcaagagccggcccgaggggaacaaggccaaaacgttcaaacttaaagggcaccccctggctttaggtcggcaaagtaaaacccccctttaaccgttggccaaggggaaagggcaaacccccccttcaaaaatctcggggccctcttttaatttcccggttcgggccccccaccccaattgggggggggttttcatagaatttggggccccccctttttccccttggtctcccaccccggggggtttttttttaaaggaaa

SEQ ID NO: 87878 - protein, 116 aa, Zea mays
  misc_feature: Ceres CLONE 1575038
  misc_feature: SWISSPROT Homolog: EC 6.1.1.22 Asparagine--tRNA ligase
  misc_feature (82)..(82): Xaa is any aa, unknown, or other
  misc_feature (90)..(90): Xaa is any aa, unknown, or other
  misc_feature (95)..(95): Xaa is any aa, unknown, or other
MAADAAAAAMSATSLCDDLEPATVRTRIRDVLAAGAARAGDRVVVGGWVRTGREQGKGSFAFLELSDGSCAATLQAIVDAAXAPLARLTXHGHLXSSSRGVDQEPARGEQGQNVQT

SEQ ID NO: 87879 - DNA, 862 bp, Zea mays
  misc_feature: Ceres CLONE 1575039
  misc_feature: Encodes the peptide sequence at SEQ ID NO. 87880
ctggagctcaccgcggtggcggccgctctagaactagtggatcccccgggctgcaggaattcgtctcacccctagaaaaagaagccgcgccagccaaaggcgaccgccgcccgggcgccagcccactcaaaccctttggtctcctgtcctctcttcgtccaccgcgtcgtcgtctccctccctccgtccccgcacccaccgttatatacaacccccgtcgggactacactcaccaccgcgcctcgaatccatcgctcaactactcgaacccgactcaccggcgcctactcccgcctggctcccgggcccattcgtcgacccgtcgccgggcgaaagcgcgccactaaggtctccaacctccgcccgttgaagcgacggcgccgcatcggaggaactgtagctgttagtccgcctcttctcggcagcgcggggcggagatccgaccggacttgggatcgattccttcccttttctcgattcagggcgctaacagttcctgagggaagcttctggggacatggacatggcattgcccgttgtgaatgccacagcggcggtgctcgcccgtgtctcggctgccttcaatggcccccttgcccgcgcagtcgtctttggggtccatattgatggtcacttggtcgtggaagggcttcttattgcagtcatagtgttccagctctccaggaagagctacaaaccaccaaagaagccactcactgaaaaggagattgatgagctatgtgatgagtgggagccagagccactatgccctccaatcaaggagggggccaaaatagatgctccaacattggaaaagtgcgctggaccacatacgaatttgtgatggtaaagaagttgtgaa

SEQ ID NO: 87880 - protein, 108 aa, Zea mays
  misc_feature: Ceres CLONE 1575039
  misc_feature: SWISSPROT Homolog: EC 2.3.1.50 Serine C-palmitoyltransferase
MDMALPVVNATAAVLARVSAAFNGPLARAVVFGVHIDGHLVVEGLLIAVIVFQLSRKSYKPPKKPLTEKEIDELCDEWEPEPLCPPIKEGAKIDAPTLEKCAGPHTNL

SEQ ID NO: 87881 - DNA, 860 bp, Zea mays
  misc_feature: Ceres CLONE 1575040
  misc_feature: Encodes the peptide sequence at SEQ ID NO. 87882
aaaactggagctccccgcggtggcggccgctctagaactagtggatcccccgggctgcaggaattcgtctcacccctagaaaaacaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgattttcagtacgaatacgaaccgtgaaagcgtggcctatcgatcctttagaccttcggagtttgaagctagaggtgtcagaaaagttaccacagggataactgggtttgtggcaagccaacgtttcaaagcgaccttgcttttttgatccttcaaaggcgggtcctttccatccattggtgaagcaaaaattcccaaggggttggaattgttcccccccccaaaaggaaaactgaacccgggtttaaacccccctgggaacagggttttttttcccttc

SEQ ID NO: 87882 - protein, 55 aa, Zea mays; identical to SEQ ID NO: 82409
  misc_feature: Ceres CLONE 1575040

SEQ ID NO: 87883 - DNA, 882 bp, Zea mays
  misc_feature: Ceres CLONE 1575042
  misc_feature: Encodes the peptide sequence at SEQ ID NO. 87884
  misc_feature (710)..(710): n is a, c, t, g, unknown, or other
  misc_feature (735)..(735): n is a, c, t, g, unknown, or other
  misc_feature (742)..(742): n is a, c, t, g, unknown, or other
  misc_feature (882)..(882): n is a, c, t, g, unknown, or other
gagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcagcgatctgttactacggtggcccgtggggaacaagttcggctcctgtcgtcacgcgaccgcggttcactcgcaggggcagtgaacgtgctgctgccggccacgggnacggcgagggatcttggggtcgcgncatgccnagcgagagatctcgacgaaggccttctcgtcgctgtttctgtttccccactggcaacgcttccgaaaaagaactttaaggcggggggttccccgcctgtcaaaatgaatggtgggcgaagtccggcctacctttcccttn

SEQ ID NO: 87884 - protein, 215 aa, Zea mays
  misc_feature: Ceres CLONE 1575042
  misc_feature: SWISSPROT Homolog: EC 3.2.2.22 rRNA N-glycosylase
  misc_feature (180)..(180): Xaa is any aa, unknown, or other
  misc_feature (188)..(188): Xaa is any aa, unknown, or other
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVVTRPRFTRRGSERAAAGHGXGEGSWGRXMPSERSRRRPSRRCFCFPTGNASEKEL

SEQ ID NO: 87885 - DNA, 875 bp, Zea mays
  misc_feature: Ceres CLONE 1575044
  misc_feature: Encodes the peptide sequence at SEQ ID NO. 87886
caccgcggtggcggccgctctagaactagtggatcccccgggctgcaggaattcgtctcacccctagaaaaaattcacgaatcccgtcttcttcctttcttggccttctccacctcatcgccgagacgagatctctcccacacgaggagggcagcagggaagggagagatgggcgggcgggtggatcacgagtactcctacctgttcaagatggtcctcatcggagacagcggcgtcggcaagtccaatatcctctctcgcttcacgcgcaaccacttctccctcgactccaagtccaccatcgacgtcgagtacgccaccaaggccctgcagatggacggcaaaacaataaaggctcagatctgggacacagctgggcaggaaagcccccccggggtacaagtgcttactaccgtggagccgtgggagcactgcttgtgtccgacatcacaaagaggcagagcttccacaatgttcacaggtggcttcgtgaactccgcaaccctgctgaactccagtagtgtggatcctggagggcgggtaacaaatctggaactaatcccacctgagaacctttcttctgaaggatgaagggcaaaacctttggcctgaaaagggagggggtgtttctttcctccgagaccctcaggctatgggaggattagtaaacctgggaaccaaggcctttcccgaagttatctatgaaagggaaggtcttatggggcatttgaccaacaggggaaagggttttgtgttttcccaaaaaaagccaagcaagccttgctaaatgtgccttacgtttgccccctcccccgagggagttaaaaatcctttccacctattttgagaatcgcacttgttaggggaatacacac

SEQ ID NO: 87886 - protein, 140 aa, Zea mays
  misc_feature: Ceres CLONE 1575044
  misc_feature (14)..(116): Pfam Name: Ras Pfam Description: Ras family
MGGRVDHEYSYLFKMVLIGDSGVGKSNILSRFTRNHFSLDSKSTIDVEYATKALQMDGKTIKAQIWDTAGQESPPGVQVLTTVEPWEHCLCPTSQRGRASTMFTGGFVNSATLLNSSSVDPGGRVTNLELIPPENLSSEG

SEQ ID NO: 87887 - DNA, 1333 bp, Zea mays
  misc_feature: Ceres CLONE 1575047
  misc_feature (1009)..(1009): n is a, c, t, g, unknown, or other
  misc_feature (1079)..(1079): n is a, c, t, g, unknown, or other
gagaagaagaaatttaagggaggcgacaaaacacacagccacagagaacacgcgcccggccccgcccaaaaaaaaaaaaaccaacccaccgcgggggcggccgcatttacacagtggatcccccgggctgcattacttcgtctcacccctagaaaaaaaaatagaaaaagtacccgcgcgctcgcgccctgaaatttcacaacaccaaacccgcaggggcggagaagcgcaaagccacaaggagtgcgaggcgagggccgacaccggggacaagcacggcgcggcggcggaggcagcaatggcggccctgcagagttggcccaaggcgcacggcgcgcataaagacgccaccacgggcagggtcgccgatgtcgaagtggagtagaaggatatggaagacacaaacctaaaggccaccaaccacgtggagagtccgcccaagcaccccaccagcaaaagaatgaggaaggagagggccaatgggggaccaccccgagggggaaggcagagacggagcggcatgtgatgtgcccgaaacaacaccggcagaacggagggagcgtggaaggggcggccacttaacaaccaccccgcgggggggagtgcggagcggcgtcccgggggagggaagaggagaaccccttgacgacctcgggggggataaaaagggtgtcgcgataacagatgaggaggcgccggaagcgtgtgaagatgggaggactatgcgcgagccgtcgcttgagagaaataacgcgctgaaaggggcggacagaatagacacaccagtggccgcgcgaggaaatatacacttctgcgcggcaaaaaaatgagataatataaacaacctggcaagcgaggaggggtgatatacgacgacagaatcgcacgtaaatagtaggaagatggtggtgaaagaatcgtacaagactcggcgttttagtcggtatacagaggtgacgtgcagccagaagcacgtgatatacaatcgacgcgagcggctgcggctatngtataagtcgcacaacgccgaggctacaagagtgtaggagcgactcgaggtggacacacaggagtcggtntctgatcgccgtcgaaacacagccgggcgggcgtcgctcacatacgctatgcagtacacacgaatctagaacgccgccacaccgtatgtaatggactgggtatgatggcggagtaggcggcgcgagataatcgcgcgcacggcaagcagttgctgaaggagcgcccataagtaggtcgcacggtgtagcacgcacgtcggcccgagagtttgagacgagagagagacatgcataggtagcgggagcaccggagc

SEQ ID NO: 87888 - DNA, 857 bp, Zea mays
  misc_feature: Ceres CLONE 1575049
  misc_feature: Encodes the peptide sequence at SEQ ID NO. 87889
ctggagctccccgcggtggcggccgctctagaactagtggatcccccgggctgcaggaattcgtctcacccctagaaaaaatagaaaaaattcgagaagccgaagaaaattcgaagacgaggagcagctacactgcggacggacttcgggcatggagggccagttccaggttggcaaggaggaggtcatccaagcatggtacatggacgacagtgaagaggaccagaggcttcctcatcatcgcgagcccaaagaattcatccctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgccttgagggtagcggctactttgatgtgagggaccaagatgatcagtggatccgtgtagcggtaaagaaagggggcatgatcgttttgcctgcaggaatgtatcaccgctttacgttggatagtgacaactacatcaaggcaatgcgtctatttgtgggcgagcctgtctggacaccatacaatcgtccgcatgaccatctcccggctaggaaggagtacgtcgagaaaatcatcaaccgaggtggaaaacaagccgtcgaagctcgttgagcgtgtccactctacatgtcctcctgccgtctcagccctcttgtgtttacactcctacactcctagtaccgccgaataagaattgctatctgcaatgtgctcatgccac

SEQ ID NO: 87889 - protein, 198 aa, Zea mays
  misc_feature: Ceres CLONE 1575049
  misc_feature (14)..(168): Pfam Name: ARD Pfam Description: ARD/ARD' family
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQDDQWIRVAVKKGGMIVLPAGMYHRFTLDSDNYIKAMRLFVGEPVWTPYNRPHDHLPARKEYVEKIINRGGKQAVEAR

SEQ ID NO: 87890 - DNA, 854 bp, Zea mays
  misc_feature: Ceres CLONE 1575050
  misc_feature: Encodes the peptide sequence at SEQ ID NO. 87891
  misc_feature (854)..(854): n is a, c, t, g, unknown, or other
ctggagctccccgcggtggcggccgctctagaactagtggatcccccgggctgcaggaattcgtctcacccctagaaaaaagcagaagaggacaaaccagattcgattcctcctcctgtcctccatctccccaattcgcacggccatcggaccatggattccggcgtgcctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccgccaagttctacgactgctgcggcgccgaggaccccgacgctcccggctgcaccactgacttgcaccgttcctacgacgacgcccaagactagcaaacctttgctgcttccacaggcctcatcttaatctcaagtctcatctaccgtttcgcttttgcatcccctccttatcctctctagtcagctatcaaattaaaccatctatgtacacttaaataaattttgcttcagatatgttacctactggagcaatttttttctttttcttttttgcaattgatcaaacatatctctcctcgtcgatatgttggcttctctcggtagcccgattgtatgagccaggccggcaggagcctagctccagagatacgaccaatttgctcgtgcctgcagagcctggctcaggatgctttaagtatcgtacgagcctgactccacatctacacgtagggtacccaacatacacctcgcacgcgtagagtctggtttgacaacatcaaacaccactn

SEQ ID NO: 87891 - protein, 94 aa, Zea mays
  misc_feature: Ceres CLONE 1575050
MDSGVPASAPAPPKHKTCRKCKASYDPSANTRLSCRFHPSFFVCRRHDDQKRYYELRDGDPPYAAKFYDCCGAEDPDAPGCTTDLHRSYDDAQD

SEQ ID NO: 87892 - DNA, 875 bp, Zea mays
  misc_feature: Ceres CLONE 1575053
  misc_feature: Encodes the peptide sequence at SEQ ID NO. 87893
  misc_feature (808)..(808): n is a, c, t, g, unknown, or other
ctggagctcaccgcggtggcggccgctctagaactagtggatcccccgggctgcaggaattcgtctcacccctagaaaaaatatgatgactcttttgaaacttgagttgtattcatacaaaaggcaagagaagcatttcatgacagccatagatctcatcgcagatgccttcttcaagcatggtgagaaggacccactgagatcttgcatcaaggcaattattttctgttgcactgagtgccaggctgatcttaaagattatgctgaaaataaacttaagaatcttgaagatgagttggtcttgaaagtcagaactgcaatcaaggaagtagaggcaggtgatgatgaatactccctcttggttaatttgaagcggctttataaacttcagctgtcaaaacctgttaagaatgatagtttatttgaggatatgtaccgaatactagctcatcttagagatatggataatgaggtgaagagctttctcctcctcaatatgtatcttcaagtagcttggtgccttcatgcaattgatggtgaaaacccatctgaaacatgtattgatgaacttttatcaaagcaaagctcactttttgatcaactctattattatttagtggtactgcccacttatcagaaagaggggaggagcaccactgtactttcatgcagagtctgcatcattactgcagaaatgtggtgcttgtttaagaagtcaaaatattcttcgacaagactagagagtttgggttatttcccacagccagatatggttcagaagttctggaaactatgtgaacaacagctncacatatcagatgaaacagaagatgaaagatgcaatgaagaacatattgcagacacaaacaggtatg

SEQ ID NO: 87893 - protein, 264 aa, Zea mays
  misc_feature: Ceres CLONE 1575053
MMTLLKLELYSYKRQEKHFMTAIDLIADAFFKHGEKDPLRSCIKAIIFCCTECQADLKDYAENKLKNLEDELVLKVRTAIKEVEAGDDEYSLLVNLKRLYKLQLSKPVKNDSLFEDMYRILAHLRDMDNEVKSFLLLNMYLQVAWCLHAIDGENPSETCIDELLSKQSSLFDQLYYYLVVLPTYQKEGRSTTVLSCRVCIITAEMWCLFKKSKYSSTRLESLGYFPQPDMVQKFWKLCEQQLHISDETEDERCNEEHIADTNRY

SEQ ID NO: 87894 - DNA, 855 bp, Zea mays
  misc_feature: Ceres CLONE 1575054
  misc_feature: Encodes the peptide sequence at SEQ ID NO. 87895
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (816)..(816): n is a, c, t, g, unknown, or other
ctggagctccccgcggtggcggccgctctagaactagtggatcccccgggctgcaggaattcgtctcacccctagaaaaaaacatcgccgacagctcccccacagcagccagccatccatatgtatgtaccattcatcctccactgcatgcatgctaccggcggcggcccaagcttcatcgatcgccgatcatcttctagctagcagctagcttgttattagctcatcggcgatggactacgtggtcgcccggatgcaattgcaacaagcagcagtgccgccgcctgttcactccatcgccgaccaccgtcctccgcctgtgtcgcagaggacgcggggcagcgcgacgatgcaacgacagcggcgtgaggcactcgaacaggaggtggcagagctgaagcagcagctatccaacgagcagacggtgcaccagatcctggagcgcgccctgcagcccagcagctccatggccctcgccaacatccccgccttcatccccaccaaggccaaggagctgctcgcggagctgctgctggtgggaggaagagatcgccaggctggaggaccagataaaaaggatgaagaagtccgccgccacgcagcagcagcagcagacggagcactgcaagtccatgttcttcatcagccaggccatggacggcgaggcgtacctcagcacggtggtgaaacaacaagaggcattccctggcgtcgtcgtcagatgggcatgcgnnntgtggagaagaagatcgcccagcacgagctgcccatcaccaagaagagccccacggtgatagcaaagaagagggcgagagnacagcagcagccgccccaacagcttgtcggagaagatca

SEQ ID NO: 87895 - protein, 207 aa, Zea mays
  misc_feature: Ceres CLONE 1575054
  misc_feature (168)..(168): Xaa is any aa, unknown, or other
  misc_feature (195)..(195): Xaa is any aa, unknown, or other
MDYVVARMQLQQAAVPPPVHSIADHRPPPVSQRTRGSATMQRQRREALEQEVAELKQQLSNEQTVHQILERALQPSSSMALANIPAFIPTKAKELLAELLLVGGRDRQAGGPDKKDEEVRRHAAAAADGALQVHVLHQPGHGRRGVPQHGGETTRGIPWRRRQMGMRXVEKKIAQHELPITKKSPTVIAKKRARXQQQPPQQLVGED

SEQ ID NO: 87896 - DNA, 1055 bp, Zea mays
  misc_feature: Ceres CLONE 1575058
acccgcggtggcggccgctctagaactagtggatcccccgggctgcaggaattcgtctcacccctagaaaaagccccactcaacaccaacgttcgctcgtgtcgtgtctaattgtctgccactgagacaaaaataggcggcagaaatttaacgaccggtatgtcgtctgaatgaatcgcccgggcgtcttccttcggcatccccttccaccaccaacagtgacgaccgagagacacacagagagaatggccgcgccagatgcccggccctcgatcagacgaggcagcgcaggcgcgctccctcgtcctgcttctcctgctcgtgatcctcaacgcggcgtactcactgccagccgactcagtagcgcgcccgttgtacatgtggaattttccccccccccacacgacaaacgcggctgaagcggcaccagctggcggcgcccgagacagcagcaactccgagtttcgtcggacgggccccgtcagacgctgtcgaccgaggcccgttcatgggctcaccaactgtcgcgcagcatgttctgaccatctttaatctttcaccgccctcctaggttgcgcggtgactttcctgccacagtgtgccttccttcaaacgatcagccttactggactttcggactctggtgcccgggtggcactggacaatcgaccgggtcccccgtccacggctaagttttgagagtttcctcgggaaggaacgtgggggtcgaatgttctaagttgggtttcgcctacaccaaacaacaggtgttgtccattggtttccaactaagggtggcaccaaggtttggggccgacacgtacattcgttctttcttagggagccagcctgggtttcttacctggtaaatgtagagagtccgtgttcgggagaaacgcaccaccgtaacattgtttttggctcggagaccctcatagggattttctttaccgatctaacgcacagggggtgttgggggccagaatttctctcggttgtgtgtatcagtgaggaccctggagaggtggggctctttgtgggcctgcgagagcccg

SEQ ID NO: 87897 - DNA, 925 bp, Zea mays
  misc_feature: Ceres CLONE 1575062
  misc_feature: Encodes the peptide sequence at SEQ ID NO. 87898
tggagctcaccgcggtggcggccgctctagaactagtggatcccccgggctgcaggaattcgtctcacccctagaaaaaattaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaaggtgaactagatttttcacgataaagtcctccgggtctgtaagtggaaacctacgggatctggcttgggggaacaccgggtcatcataaggatccgttaaacgtttccaaagcaaccgctcgaacgtaagggactccttttgggaccgaaggaatggcccaaccttttcctcacctccccacattaagacggggggaaaaaatcctttggaaattcacccgggggggggccttggggggggaattttcaacatcaaaatggggtttttcacaccggaaaaaaggggtgggcttttttccacacccctcgggggaaaaacctttttcccaaggtttttacccctttgaaagcccccccccgcggcccccccaaaagaagtaaaaaaaagggccccctttgggggcggcccccccgcgcggggggggggcgccccttacaccctctgaagaggtggttttttctcccccccggggggagagaaacaaaggggggaaagaccctctttttttttttgtttttctatccacc

SEQ ID NO: 87898 - protein, 81 aa, Zea mays
  misc_feature: Ceres CLONE 1575062
MSIKSINGKSPIVVGPWGGTGGYPWDDGVYSTIRQIVIGHGAAIDSIRIEYDLKGRSVWSETHGGTDGGSETDKGELDFSR

SEQ ID NO: 87899 - DNA, 763 bp, Zea mays
  misc_feature: Ceres CLONE 1575065
  misc_feature: Encodes the peptide sequence at SEQ ID NO. 87900
ctggagctccccgcggtggcggccgctctagaactagtggatcccccgggctgcaggaattcgtctcacccctagaaaaagctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacagcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgccaactgactcccggcgtttcgcggcggagctcagggccaccccccggccggaatcgccggcatggcgcctgcggccgtcgcgtcactgtacacgctgcagggcaagaaaggccgtcaaccaggatgctatgatctttctgggagacttctggttcagaagagaaaccttccttttgggggtgggtttgacgggccatggac

SEQ ID NO: 87900 - protein, 143 aa, Zea mays
  misc_feature: Ceres CLONE 1575065
MVTTRSVGPAAVAEGDGAGAAVTDAGAAGGGGRCMEDFFDCLLGLLGALGMTWAAARPQRQPRPPLPRGAAGAGPAPTDSRRFAAELRATPRPESPAWRLRPSRHCTRCRARKAVNQDAMIFLGDFWFRRETFLLGVGLTGHG

SEQ ID NO: 87901 - DNA, 851 bp, Zea mays
  misc_feature: Ceres CLONE 1575067
  misc_feature: Encodes the peptide sequence at SEQ ID NO. 87902
  misc_feature (708)..(708): n is a, c, t, g, unknown, or other
aagctggagctccccgcggtggcggccgctctagaactagtggatcccccgggctgcaggaattcgtctcacccctagaaaaaacctcactccacctcgttcgccgcctcgctgccgcgtcgggccagtgcgtgcgtgggggcgggcgtgagtgactggctctcctcggcgcgcggacccaggggcggcggcgatggggaagaatatgcgcatcaagacggcgcccaaggcgaaccgtgtccccctcctcggcgacggggagacgtcaagggcgctctcggacctggaagagggcagcgacgtccagccagcgaacgtcggcttctgtcgggtcatcaaacttgcgaagcatgacgccggaaagctggtcctcgccaccgcggcgctgctcgtcgcctccctcagcaaccttctcgttcccaaatatggtggaaagataattgacattgtgtcaagagatgttcggcgcccagaagataaggcgcaagccctggaggatgtgaagggcacaattttgtacattgtgacaatcgtcttagtcggttcagtttgcacggctcttcgggcatggctattcaattctgctagtgagagagtagtcgctcgactaaggaaagacttgttcagccatctcataaaccaggaaatagcgttttttgatgtgactagaacaggagagctctttagcaggctttctgaagatacacnaataataaagaatgctgctatcaccaacctatcagaagcactgcgcaatggtactactacagctattggtcctggtttcttgttttcacttcatgggagttacattgctggcactgtaattgttccgggtatatcaggtgctg

SEQ ID NO: 87902 - protein, 219 aa, Zea mays
  misc_feature: Ceres CLONE 1575067
  misc_feature: SWISSPROT Homolog: EC 3.6.3.44 Xenobiotic-transporting ATPase
  misc_feature (172)..(172): Xaa is any aa, unknown, or other
MGKNMRIKTAPKANRVPLLGDGETSRALSDLEEGSDVQPANVGFCRVIKLAKHDAGKLVLATAALLVASLSNLLVPKYGGKIIDIVSRDVRRPEDKAQALEDVKGTILYIVTIVLVGSVCTALRAWLFNSASERVVARLRKDLFSHLINQEIAFFDVTRTGELFSRLSEDTXIIKNAAITNLSEALRNGTTTAIGPGFLFSLHGSYIAGTVIVPGISGA

SEQ ID NO: 87903 - DNA, 1316 bp, Zea mays
  misc_feature: Ceres CLONE 1575069
  misc_feature: Encodes the peptide sequence at SEQ ID NO. 87904
  misc_feature (49)..(49): n is a, c, t, g, unknown, or other
  misc_feature (65)..(65): n is a, c, t, g, unknown, or other
  misc_feature (493)..(493): n is a, c, t, g, unknown, or other
ttaatttttaatttatttttatttatattagaaaagacagcgtacaaanattatacccccctctncacaaactggagctcacctcggtggcggccgctctacaacagaggagtggacgctctgctgagggcggctcgatcctataaaagagagttacggacgcgtacaggcgccagctgctggctcagtcatggtggatccggctcctcggccccttcgccgaggagctgcgggaggcacgccgggggtccgcgtagcatgaggagcaagaacgggcgctggcgcctctcgccgacgcgctggatgagggcactcgacctgctccaactataccgtgactgcagcaggatatttttggtccttgatagggatgaaaacatgaagaagttccaggagtcgtttggttaactggagaaagccctgttgcaatttcccataggaatgagacttggatattttttgaattaatatttgtcgacaccccccaacttanttaatacttatcttttaatataagcctaagcatgagtgttaattatgctcgaattaaggggggtttataaaaataaatttttgttccgatggtaataacaatggagcctcgaatttctaagaatctatgaaatccggaatatatccctttaagggaaaataattaattgtgagagaagacatttccttgttgaaataaaccagtataggctgaaagaccttaaatcatttagagaaatatgacgaccgggagggacatgttggaatagcggaggaagattgggatgtggaaaaccttcacggagagttggattctgatcataaatacgcgtcgctatgatttttggatattgaagaacacaacaacgttcgcgggtaatataaaaaatatcgcattccgcatgttatgctccgtgtgcgcttgaagatgtagacatatatatctctaggaggtagagttctcggtactgtcgtctagatatatttattcaggagcaaacaacttaattgtagaaaatagaagtgtattactttatagcctgcgtgttacgacgatgtattctctatattacaccatatgaagggtgcgctccccacaagttgatgctgatatcgcttcctaatgaaactccacatttagacgaagattctggcatcttgtatcgcaacatatgaccgtcaaagacgagccacaactacttttgatatcttttaggaattgtatattctgaataacaagaactcgacgtaacactctggtaatgaagatccggggtacgtaataccgtgacaatatctgtatgaattacagatgagttcgtgat

SEQ ID NO: 87904 - protein, 49 aa, Zea mays
  misc_feature: Ceres CLONE 1575069
MRSKNGRWRLSPTRWMRALDLLQLYRDCSRIFLVLDRDENMKKFQESFG

SEQ ID NO: 87905 - DNA, 877 bp, Zea mays
  misc_feature: Ceres CLONE 1575070
  misc_feature: Encodes the peptide sequence at SEQ ID NO. 87906
  misc_feature (391)..(391): n is a, c, t, g, unknown, or other
  misc_feature (425)..(425): n is a, c, t, g, unknown, or other
  misc_feature (548)..(548): n is a, c, t, g, unknown, or other
ctccccgcggtggcggccgctctagaactagtggatcccccgggctgcaggaattcgtctcacccctagaaaaaactcatcagttttctcatctcagctcagctagctttcccctcccttgcaactgcaagcttgcccaacccaataagctaagcaagcacgcaccatacacactctctagtagctagctaagctagccggccgcccctcctcgcacgcgtgcgcgcaccagcatctatcatcagagctagccacgaaacggatcggagcagcagatctcgatcggcggcccacatgggggatcacgctgagatgttgcatgccgctccggccatgtacaacggcgctggcgctgcccctcatggcgggtggtggaatacggcggtgcccncaacgacgtgctcgacgacggagctggctggggntcacacgtggtcgtccgccctggctgctagctacgacctggcggccgaagggacaaaagccaagagcgcccgcgcctcctcggagtcccccgggaacaacagcttcgtgaccttcccagaacngggctggcgtcacggatcctcccggcgtcggaaaccgccgtggtggcaggtgcaaagccctctcgccaccggttacgcccaatgggacccatcccttattagaacaggggggcctcacacttttgcagggggttttggcaaaaagggcccccgcggggaaatgagtcctccacctggaagaagattccttgacccgcttaaaggcctaaaaacccccttttcacaaaaaccaaacccctggggctcttcggggggccccccccgggaggattgacccccccccggaaaaatgtgttccccattttgagaaaaaagaggttttttttttc

SEQ ID NO: 87906 - protein, 175 aa, Zea mays
  misc_feature: Ceres CLONE 1575070
  misc_feature (33)..(33): Xaa is any aa, unknown, or other
  misc_feature (44)..(44): Xaa is any aa, unknown, or other
  misc_feature (85)..(85): Xaa is any aa, unknown, or other
MGDHAEMLHAAPAMYNGAGAAPHGGWWNTAVPXTTCSTTELAGXHTWSSALAASYDLAAEGTKAKSARASSESPGNNSFVTFPEXGWRHGSSRRRKPPWWQVQSPLATGYAQWDPSLIRTGGPHTFAGGFGKKGPRGEMSPPPGRRFLDPLKGLKTPFSQKPNPWGSSGGPPRED

SEQ ID NO: 87907 - DNA, 789 bp, Zea mays
  misc_feature: Ceres CLONE 1575075
  misc_feature: Encodes the peptide sequence at SEQ ID NO. 87908
  misc_feature (523)..(523): n is a, c, t, g, unknown, or other
aaagctggagctccccgcggtggcggccgctctagaactagtggatcccccgggctgcaggaattcgtctcacccctagaaaaagcggcttccacaccaccttagctcggccggtggcggtctgcttccgaccgtccgccggtttgcttgcttgcttgcttcatctgcctccgccgcacctcgcctccgtccagccagccagccagcgccaagtcaagcgatccggccgcacccagcctcgacctacccggccgacccgtgagggcggtgtgtttgcccttcaacggcctcgcctcgcctcgaggtgtgagctcctccgacatctgctgcggcgccgccgtttctgcaagcagggttatcttcccttctcgccgccaggagtgagtctgtgagtgggtcactgcagggcggggctcttccaccactgcaggccgggagaaagaaaaaaaagcagcagcttggattcttgctaggggcgcgcggttggtcagctcaagagaaagctgaccgggtttgggcgtcnagatttcgattgacttttggaggaccccggggaatagtctaacaatacaggttgctttcttctggcacgctggctttcttgggtcctggggctaacccgacccttgctggttttccctccccaaattaaggggtgaactccctttcaaaacctttcaaaaaatttggacctttgtgggggggtgttcccccacacaccccaaaattggcgccccgcgggggggaaaatttttaaactttttctgggggaaaaaaaacccaagaggg

SEQ ID NO: 87908 - protein, 34 aa, Zea mays
  misc_feature: Ceres CLONE 1575075
KAGAPRGGGRSRTSGSPGLQEFVSPLEKAASTPP

SEQ ID NO: 87909 - DNA, 890 bp, Zea mays
  misc_feature: Ceres CLONE 1575076
  misc_feature: Encodes the peptide sequence at SEQ ID NO. 87910
  misc_feature (668)..(668): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
aaagctggagctccccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggcggcctcatcttcggctacgacattggcatctcaggaggtgtgtcggagatggaggatttcctgaacaagtttttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcgccaggcgtcatgctgatcggcggcggcctgttcttgggcnggcgcctcgtcaacgccgccgcgccaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 87910 - protein, 115 aa, Zea mays
  misc_feature: Ceres CLONE 1575076
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQASC

SEQ ID NO: 87911 - DNA, 828 bp, Zea mays
  misc_feature: Ceres CLONE 1575078
  misc_feature: Encodes the peptide sequence at SEQ ID NO. 87912
  misc_feature (713)..(713): n is a, c, t, g, unknown, or other
  misc_feature (750)..(750): n is a, c, t, g, unknown, or other
ctggagctccccgcggtggcggccgctctagaactagtggatcccccgggctgcaggaattcgtctcacccctagaaaaaaccaactcctgcacgccgcgtcgagatcgttcacgccttagcttcgggaactccaccaataagcccaccggctggagcaatggggagcacggggcgcgagccggaggtgacccgcgccaacttccccgacggcttcgtcttcggcgtcgccacctccgcgtaccagatcgagggagcgagaagagagggaggcaaaggagacaacatatgggatgtatttacagatgacaaagaacgtgtcttagacagaagcaatgcagaaattgcagttgaccactaccatcgatacaaggaagacattgagctcatggcaagtctaggttttagcgcatacagattttctatatcttgggcacgtatatttcctgatggcttgggggaaaaggtcaatgagcaaggagtcgccttctataatgacctcatcaactttatgatttcgaaaggtattgagccttacgcaacactgtatcattgggatcttccaaacaatcttcaaaaaactctggggggctggatttctgacaagattgtgtaagccactgcaggcatcttaagcgtgtagtatgaatgtatgattaccgaagttttcttaacacgcaaatgaatgggtacatatgagattcttctcgactncaccttttttgtttcaaagtgtttgcagcttgatttngctgtttttacgagtttctcaccataaaaatatcttagggagtactttgcattgtatgcagaagctttgcttgcaaat

SEQ ID NO: 87912 - protein, 151 aa, Zea mays
  misc_feature: Ceres CLONE 1575078
  misc_feature (11)..(151): Pfam Name: Glyco_hydro_1 Pfam Description: Glycosyl hydrolase family 1
  misc_feature: SWISSPROT Homolog: EC 3.2.1.21 Beta-glucosidase
MGSTGREPEVTRANFPDGFVFGVATSAYQIEGARREGGKGDNIWDVFTDDKERVLDRSNAEIAVDHYHRYKEDIELMASLGFSAYRFSISWARIFPDGLGEKVNEQGVAFYNDLINFMISKGIEPYATLYHWDLPNNLQKTLGGWISDKIV

SEQ ID NO: 87913 - DNA, 752 bp, Zea mays
  misc_feature: Ceres CLONE 1575079
  misc_feature: Translation starting site: 198
  misc_feature (405)..(405): n is a, c, t, g, unknown, or other
  misc_feature (418)..(418): n is a, c, t, g, unknown, or other
  misc_feature (500)..(500): n is a, c, t, g, unknown, or other
  misc_feature (503)..(503): n is a, c, t, g, unknown, or other
tggagctccccgcggtggcggccgctctagaactagtggatcccccgggctgcaggaattcgtctcacccctagaaaaaactccctctcgaaaccctagtcctctgttacttctcccgccgccgccaatccccttccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccngtctttgatgccnaagcgtctcattgggcagagggttagtgatgcctctgtccagagtgatattaagctgtggccccttcaggtcattcctgggnccnggtgagaagccatgatagttgttcagcacaagggggaagaagaacagtttgcagccgaagagatcttctcccatggttctcatcaagatggctggagaatcgctgaaagcttaccttttggccggcccgaatcaaaaaatggctggtggtcccgggtcccctgggcttacttttaaaggactttccagagagggcggggggcccacaaaaaagaaaacccttggggggggataaattccggggcgcccc

SEQ ID NO: 87914 - DNA, 891 bp, Zea mays
  misc_feature: Ceres CLONE 1575080
  misc_feature: SWISSPROT Homolog: EC 3.4.21.92 Endopeptidase Clp
ctggagctccccgcggtggcggccgctctagaactagtggatcccccgggctgcaggaattcgtctcacccctagaaaaagaagataataaactgcggattctttctttctcttccattcttacgtttccatattaaagtgtagtttttttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccagcgtatagcattccctcacgctaggattatgctttcacaacctgctagtgcttattatcgggcaaggacaccagaatttttactagaagtggaagaagtacccaaagttcgcgaaatgatcacaggggtttatgcctaaggacaagccagccttttttggttgtattcgaaaacatggaaagggatttttttatgttagcagaccaggccaaagctttaggaactggcaaatttggaggggaaataaaatgatttacaaaccctgggaaacttgaccagggggggttttccaaaaattttaaaggatggggaggggggggggatttctttgaaaaatttctccaaaaccaaaaattcggggttttaaggcaaa

SEQ ID NO: 87915 - DNA, 1004 bp, Zea mays
  misc_feature: Ceres CLONE 1575081
  misc_feature: Encodes the peptide sequence at SEQ ID NO. 87916
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
atacatttgcaaaaaagaaaccagatacactccaaccccacgaaaataatcaaaaaaaaaaccaannnnnnccaaaagctgggactccccacggtggcggccgctctagaactagtggatcccccgggctgcaggaattcgtctcacccctagaaaactccctccctccctccctccctccctcactcatcggagcgccgccaatggccgtgtggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcggcctcgtccttctttccagggtcgccggcgccggccgctcctaagaacggccttggggagcgcccagagagcctggacgtccgcggcgttgcgcccacttctggagcctcgtctaatgccgtgagggcgggcaagacgcgcgcccacgctgccgtccccaaggtgaacggtggcaagtctgcggtggcggatgtggagcacgagaccataactgtaccttcgtcggggccgaggaccttctacaaccagcttcccgactggagcatgctcccttgctgccatcacaaccaatcttctttggccgcccgagaagccgagggaccaatgcttgaactggaaagcccggggcggccctggacttgtttcactagacactttttgggggtttggcccggattcatacattgatggggcttcatggtccgggggctgaacttcctccaatagggccccaaacgagaattggagggctgataggggacggtgttttctaggaagcaaatgtgatgtaaccaatttggccgggaaaaccgggcccttaatcagggttgaaaaaacacactggggccggcttatggggaatgggatatcggatctcccccgccaaaagaattcaccttacccgggaa

SEQ ID NO: 87916 - protein, 141 aa, Zea mays
  misc_feature: Ceres CLONE 1575081
MAASIAASSFFPGSPAPAAPKNGLGERPESLDVRGVAPTSGASSNAVRAGKTRAHAAVPKVNGGKSAVADVEHETITVPSSGPRTFYNQLPDWSMLPCCHHNQSSLAAREAEGPMLELESPGRPWTCFTRHFLGVWPGFIH

SEQ ID NO: 87917 - DNA, 856 bp, Zea mays
  misc_feature: Ceres CLONE 1575089
  misc_feature: Encodes the peptide sequence at SEQ ID NO. 87918
  misc_feature (833)..(833): n is a, c, t, g, unknown, or other
aagctggagctccccgcggtggcggccgctctagaactagtggatcccccgggctgcaggaattcgtctcacccctagaaaaactcccgaaagggctgccgtccgatgggtacacgaaagtgacgaagttgctttgactactgaaccatgcctggatcgtcggagcgaattggatgatcgggccgagggctgccccctcttcccctcgctctcctttccttaatattcaccgtcgagtcatcaaagccgtcaactaattcggaggggctcggctggcccggtcgccctacgctactggcgcttccaaaggcgaagctctcgtctttggcgaccagcaaagcaaacggagggagggctaaaacctttcgttttgaagcaagggatgagcgcgaaagccgttgcgcttccgtacacgcgcatactcttgctccgtcgcgcgttaggttaggttagtacttagtacttaacttagtacaataacgcgcagccgttttgggcggacacggttctctaaaggcgaagactctgaagtgggcgaacactcggcccagcgggcgaacatgccggctccggctccgcgcacctgctgacacctttcgaagcactttcacgtgtgaaccgaagtcgtcttgtccttcctttctcatttcagtcctcgcctttttcatcttccgtaggggcctttagtcttttgattagagtagaggtcgcgagagagcagagcgtaccgccctgccatagtcgcgaggatcttaatagtcggtcgcgactgttgtcatagtcaacgacgggtttaacttccaggaaaaacttcgaattggggaggcgatccntccggtgaactgaccgtacccaa

SEQ ID NO: 87918 - protein, 44 aa, Zea mays
  misc_feature: Ceres CLONE 1575089
AGAPRGGGRSRTSGSPGLQEFVSPLEKLPKGLPSDGYTKVTKLL

SEQ ID NO: 87919 - DNA, 912 bp, Zea mays
  misc_feature: Ceres CLONE 1575093
  misc_feature: Encodes the peptide sequence at SEQ ID NO. 87920
  misc_feature (352)..(352): n is a, c, t, g, unknown, or other
  misc_feature (912)..(912): n is a, c, t, g, unknown, or other
tcaccgcggtggcggccgctctagaactagtggatcccccgggctgcaggaattcgtctcaccccctagaaaaagatggaggccatgaaggtgattgaggaggaagaggagaatgggagtgttgccaacgttgtaccctctgctcctgctgagaatgggaccccagtaaaggaacactcttccagttcgtccaagaagtcgaagaaggcctcaaaatcacagcttgagtctgatgcctctgttggactcaatggaaaggcgtccactgaggaaggtgagagcgaggtcagcaaaccggcaagccgagttggccgacggcggaagtcaaatgccaacccacagaatggaacanaagatgctgggcttgataacccagaccttggtccacccccccccaaacatgcaagagacttgattgcctcagaaaacccacggcgggcactgaaatatgctctccgtgccacaaagtcgtttgagaagtgtgctggtggaaagccaagcttgaacttagtgatgagtttgcatgtcgttgcagcaatctactgcaacttgggaaaatacgaagagggctgtccctgtgctggatcgatccattgagatccctgattccaaggaaggccaggaacatgctcttggccaaagttttctggtttcatgcagtttgggggacacctatgggatggtaaggtcaaacttgcacacttcactgcaatgggtattgctttctggggcctgaaaataccaaaaggcgaaactttggggaagaagccaagatcccaaggggttgggaaaaaaccctgtcgggaatctttatcctgaaaggccccttggtgccagggcaccttaccaaccttcgagttggaaggcaccataggaattggtggctccgtacattagaccccctttggacan

SEQ ID NO: 87920 - protein, 173 aa, Zea mays
  misc_feature: Ceres CLONE 1575093
  misc_feature (93)..(93): Xaa is any aa, unknown, or other
MEAMKVIEEEEENGSVANVVPSAPAENGTPVKEHSSSSSKKSKKASKSQLESDASVGLNGKASTEEGESEVSKPASRVGRRRKSNANPQNGTXDAGLDNPDLGPPPPKHARDLIASENPRRALKYALRATKSFEKCAGGKPSLNLVMSLHVVAAIYCNLGKYEEGCPCAGSIH

SEQ ID NO: 87921 - DNA, 729 bp, Zea mays
  misc_feature: Ceres CLONE 1575094
  misc_feature: Encodes the peptide sequence at SEQ ID NO. 87922
  misc_feature (377)..(377): n is a, c, t, g, unknown, or other
tggagctccccgcggtggcggccgctctagaactagtggatcccccgggctgcaggaattcgtctcacccctagaaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttttgctgagaagcactacggccgatctcgcccttcaagccccttctttcaggggcctccgtggaactaaatcatctcttgcccctggggtggcatgtctgggnaggaaaaacgtcttccaattggccgcaaaacattgggcccccaaccccctggttttggaccccgggccctcccggggggaattttttttttcacatttggcggaaatgtctttttggaagaggacaccttttaaggggtttaaaagggaaattcccctgtggtttcccccaagggcctttttttttttttgaaaacacccccccccccctcgttttttccaagaaaaaaaaagggggggagttttttccctcaaccccttttgaaaccccaaaaaaaaaaaacccccccccccttttggtggtttttaaaaaatgttttgttcaaaaaaaaatttatttttttttttttttt

SEQ ID NO: 87922 - protein, 141 aa, Zea mays
  misc_feature: Ceres CLONE 1575094
  misc_feature (2)..(136): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFLLRSTTADLALQAPSFRGLRGTKSSLAPGVACLGRKNVFQLAAKHWAPNPLVLDPGPSRGEFFFSHLAEMSFWKRTPFKGFKREIPLWFPPRAFFFF

SEQ ID NO: 87923 - DNA, 964 bp, Zea mays
  misc_feature: Ceres CLONE 1575095
  misc_feature: Encodes the peptide sequence at SEQ ID NO. 87924
  misc_feature (12)..(12): n is a, c, t, g, unknown, or other
  misc_feature (51)..(51): n is a, c, t, g, unknown, or other
  misc_feature (55)..(55): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
gggggggggggnatggggagctcacaagacaccggggaaaataggggcgcncccncttttccggggggnnnnnacaaaatgggactccgcgcggtggcgtccgcactacaatagtggatcccccgggctgcattgattcgtctcacccctagaaaaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatccccatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttccttaaggacgatcagctggaggtccttggaggagcgtcgccctcaggatctgggtcaagaaagcactctgaggttcatcaggctacccccatctcccctggtgggaactgaaaaggaccaactcgaggaaagggaaattttcctggaccgaccgaaaaaacgaagggaaggagacaggataaggatggcctgaagagaaaag

SEQ ID NO: 87924 - protein, 214 aa, Zea mays
  misc_feature: Ceres CLONE 1575095
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIPMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEVLGGASPSGSGSRKHSEVHQATPISPGGN

SEQ ID NO: 87925 - DNA, 863 bp, Zea mays
  misc_feature: Ceres CLONE 1575099
  misc_feature: Encodes the peptide sequence at SEQ ID NO. 87926
ctggagctccccgcggtggcggccgctctagaactagtggatcccccgggctgcaggaattcgtctcacccctagaaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtcacggcccgcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctccgcagcagcagtacggaggcactccgctcagctcgccccccaagctcaacctgttccaccaaactcgcccccagttccaccacttcccgccgccgcaggtcggcggcctgccaatcctggagaacctgatgccgatgggccatctagaccagttcctcgccgacccaggcttcgccgagcgcgcggcgcggctgtccggctt

SEQ ID NO: 87926 - protein, 130 aa, Zea mays
  misc_feature: Ceres CLONE 1575099
MNCGPPDQLPPGSAPSCFLNLNWDQSMAADQLDPALSSMVSSPASNSTAAAAVTDGRALHGISPQQQYGGTPLSSPPKLNLFHQTRPQFHHFPPPQVGGLPILENLMPMGHLDQFLADPGFAERAARLSG

SEQ ID NO: 87927 - DNA, 897 bp, Zea mays
  misc_feature: Ceres CLONE 1575101
  misc_feature: Translation starting site: 185
  misc_feature (877)..(877): n is a, c, t, g, unknown, or other
  misc_feature (897)..(897): n is a, c, t, g, unknown, or other
ggagctccccgcggtggcggccgctctagaactagtggatcccccgggctgcaggaattcgtctcacccctagaaaaaatgcacaaaatcacatttgagggtgcccgctccttcgcctccaaccctctcgtgcttggattgctttcgatcacctgggccccgctcccaccttgcctcctcggccatggcgatgacacggccaactccggacatcctccgcgagctccagtcctgccagaacctccgcaagaggaacatgatggtttgcggggcggtggccaacatcgtcaaatctttcctcggacccgttggtctggagcagatgctagtggacgatattggtgatatgtcgatcactaatgatggagcgaccactacttaagatgtcggaagttgagcatcccaccaggtaggaacttgtaaagatagctgagctctgttatcgcgaagtatgagatggaactactatgattgtgatgacccccccagagatgatcaagaaaagcaatgaatcttgtgaagactcacatccattctagctctagaatgagtggctacaggattactatccgtcaagcctgcaaatgtagttgaggaaaagttggcagtcaaggtatgccaacgttagaaaacaatcgcttatccatctctgcaataactaacatgttcttcacaaattgattaagaggtgactgtgatttggttgacaacctttggctgctggagaccagttcaagcccgctcagactgctatatggccatgggcaaattgtgaaaataaggctatcttcttagccttcattctttttgaaaaacataatggaacaaccctccacgaaggaaacttcatttgtttagaatggcctaactcaataanacccccacgcctgttaaaan

SEQ ID NO: 87928 - DNA, 870 bp, Zea mays
  misc_feature: Ceres CLONE 1575103
  misc_feature: Pfam Name: PaO Pfam Description: Pheophorbide a oxygenase
aagctggagctccccgcggtggcggccgctctagaacttgtgggtcccccgggctgcaggagttacgtctcacccctccaagagaccagccacatggagtggtgctagggtaatgatactttgatgcagaacgtgactgagccgtcccagatcgaatttgctctgcccttggttgctggcctaagagatacagccaggtctttgactttccagatggaatcgagtggtgcctggggttagctcagagcgaattcatggtaatccgtcggttacggcaacttttgaggccccttgctatgcatctggcaatatagagatagacgctacgttacccttttttggccaccaggactgggccatatggatttgctctttcaacattccaatggccccagggaacacaccccctcttgtctgtagcgctcgagactctttccaggacacaattgccaggaaaagtgtggaggcagcttgttcctcgatggtatgaacgttgcacttcacaatttggtctatgatggcgcatggaattgatcttcgcagacactagaacatgttgcctacctgccacctaggagctcgtcgacggatatttaatcagtcgtctccacagagtacgttcatgctcacgcaagcagatcgacttgttatacctttccgcacctggctaaggaaatgtggctatatccacccggagttggtcgggaactatacgctaaaagcattgccttgccctcgtccttttgaaacgcggagatgctgaacaaacaccatacgccaaatgtcaaattgctgttctcttcgaacgaccgtaaattgcctacccgaatcctggcaaaggttcttgtgggcaacgaccttaggcttcca

SEQ ID NO: 87929 - DNA, 867 bp, Zea mays
  misc_feature: Ceres CLONE 1575104
  misc_feature: Encodes the peptide sequence at SEQ ID NO. 87930
  misc_feature (841)..(841): n is a, c, t, g, unknown, or other
  misc_feature (861)..(861): n is a, c, t, g, unknown, or other
ggagctccccgcggtggcggccgctctagaactagtggatcccccgggctgcaggaattcgtctcacccctagaaaaaaccacttcattcatctcaccttccattcctcttcctctctctctctctctcccgtgctccgttagctatagctcttcgacctccaagaagcacacggccggagtgatcagtgaagaaagacatagcataagaccgggcgggctggtggcaatgacgcggtgcctcatgttcatgccgccgctgttcctcgtgtcctccctcatctccaccgtggggctgccggtggagccgcccgcggagctcctgcagctcggaggcgacgtcagcggcgggcgcctcagcgtggacgcgtccgacatcgcggaggcgtcgcgggacttcgggggcctctcccgcgccgagcccatggcggtgttccagccgcgcgcggccggcgacgtggcgggcctggtccgcgccgcgttcgggtcggcgcgcgggttccgcgtgtcggcgcggggccacggccactccatcagcggccaggcgcaggcgcccggcggcgtggtcgtggacatgggccacggcgccgccgtggcgcgggcgcttcccgtgcactcgccggcgctgggcgggcactacgtggacgtctggggcggcgagctgtgggtggacgtgctcaactggacgctgtcgcacggcgggctcgcgccgcggtcgtggacggactacctggaactgtccgtgggcgggcacctctccacgccggcatcagcgggcagggcgttcaccacgggccccagatcagcaatgtctacgagctcgacgtcgtcacgggaagggnagaggtggtgacctgctcgnagacga

SEQ ID NO: 87930 - protein, 207 aa, Zea mays
  misc_feature: Ceres CLONE 1575104
  misc_feature (65)..(203): Pfam Name: FAD_binding_4 Pfam Description: FAD binding domain
  misc_feature: SWISSPROT Homolog: EC 1.5.99.12 Cytokinin dehydrogenase
  misc_feature (205)..(205): Xaa is any aa, unknown, or other
MTRCLMFMPPLFLVSSLISTVGLPVEPPAELLQLGGDVSGGRLSVDASDIAEASRDFGGLSRAEPMAVFQPRAAGDVAGLVRAAFGSARGFRVSARGHGHSISGQAQAPGGVVVDMGHGAAVARALPVHSPALGGHYVDVWGGELWVDVLNWTLSHGGLAPRSWTDYLELSVGGHLSTPASAGRAFTTGPRSAMSTSSTSSREGXRW

SEQ ID NO: 87931 - DNA, 851 bp, Zea mays
  misc_feature: Ceres CLONE 1575114
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (720)..(720): n is a, c, t, g, unknown, or other
ctggagctccccgcggtggcggccgctctagaactagtggatcccccgggctgcaggaattcgtctcacccctagaaaaacaaaagagggcgaggagggaaacagatcggctggcggcaatcggtagccggcttggctggcaccatgggcggcaaggcctagggcagggagcggcggctggggcggggctgagctttgggatccagaacggctctagggctgtgatggggacttggaggatccctgggacgcgacgcatctcgctgtgtgccgacctggggcgcttgactctctaggcccatgacgtccggtcgcatggctattccccacacccggcgccttttcagcgcttccctggcctcaattactaagctccacccaaaccccccgggtgcatggttcaaccttttttccaaaaaatggggaagggtttggtttccccttgaaccgaaacaattttgggcccactttccctttcccccaaaaaatctccctcttggcccggggtaattttttccccccgcggagaaaatttccccctcccccttttgggggggcaaaagagcccccaaatttcctcttttggcgcctctaaaaatttctttcgcggtgggttcccgcgggttgttcccacccgcccccacaccggggagttttttgtgggcggtttctctggggggggaaagannnagatttgaaccgccgccaaaaaaaaaaaanattttttgggaaaaaaaaaacaaaaatcgtgtccccccgtcgtttttttcaaaaaaatttttggttgagaagggctactttttttttttcaaaagttggggggcccccccagagttttatccccccccgga

SEQ ID NO: 87932 - DNA, 1265 bp, Zea mays
  misc_feature: Ceres CLONE 1575115
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (1098)..(1098): n is a, c, t, g, unknown, or other
  misc_feature (1123)..(1123): n is a, c, t, g, unknown, or other
  misc_feature (1151)..(1151): n is a, c, t, g, unknown, or other
  misc_feature (1152)..(1152): n is a, c, t, g, unknown, or other
  misc_feature (1153)..(1153): n is a, c, t, g, unknown, or other
  misc_feature (1156)..(1156): n is a, c, t, g, unknown, or other
  misc_feature (1158)..(1158): n is a, c, t, g, unknown, or other
  misc_feature (1166)..(1166): n is a, c, t, g, unknown, or other
ggtgatgtcagtatatttttttgtaagaattcattaatttgttttatcccaaggggcgnnnnnntnntnnntcaaactgggactcaccgcggtggcggccgctctagaatagtggatcccccgggctgcaggaattcgtctcacccctagaaaaaggaattgtgttgattaatatgtggtgtcatgacattggcagagaacaagctgcaaacaagcctcttttgaagactgttttccacgtcatgatgaggttgttcagtcctcgcaaaacaacattgatgtttgttatacctgacaaatcaaggacacccctagaaaatcttgagccaattctaagggaagacatttagaagatatgggatgctgttcccaaaccccatgcccataaagaaactcccattaatgaatttttcaatgttcaagttgtcgccctgtcgacctatgaataaaaaggagagtttttggaagggccccccccctcaattaagagatagggtttccgcacttcaatgtgccccttggtgggacctttattggggaacctatctaggtgttgatccccggcttgtaggttttctcaatttagccttccccaaccaagattttggggagggtgtgtcgaaggggggaatctccctgactcctgaagtttggggcctgcccccgtaacaaggttaaggggtgaggccttttctgttatcctgtttgttggaagaggaataatggggtggtagatcagataaaaaaagttctacaccccggctttgttttctatggtgcttttaacgtgagtacgcgaagtgggtgggccatatcaaggatgtttttgtgggcgtcgcagagagattgttgtgttatcttgataacccattatagaacacactactgatgttctatactcgtctgaggggggtatttttatgtggtagacagaacaaaaatattattgtggaggagaggatggctttatttatttctgccagatgaaataaaaacattgttattatattactaaaatgattcttgttataacacgcgtgtcagaaggaggtgaattctagatttgtctcctgcaatagaaaaagataaggataatantacgaatgatctctggcgtaaaaangaacacacccgaacgtgtaccggccctnnnctnanaaccgaantatgtggagaaggtaatgtgttataaagctctcgacccgtctaaagaaagagctgtatttccgcagagaggtgacacttttatccccagccgtcggagc

SEQ ID NO: 87933 - DNA, 1966 bp, Zea mays
  misc_feature: Ceres CLONE 1575117
  misc_feature: Encodes the peptide sequence at SEQ ID NO. 87934
attttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgatgcgcggcggcggggggaagggcgccgcgaccgcgaacgcgagcgggaggcaccagcaccggcgccagcgctacggcgtgggggcgccgtggagggaggagatcgcggggctggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgcaccggcgtcgtcgccacgctcggcaccggccgcccgcccgtcgtcgcgctccgggccgacatggacgcgctgcccatccaggaggccgtggagtgggagcacaagagccgggtccccgggaagatgcacgcgtgcggccacgacgcgcatgtggccatgctgctcggcgccgccagcatcctcaaggctcgcgagcaccaactcaagggcacggtgaagcttctgttccagccggcggaggagtcgggctgcggcgcgaagcggatgatcgaggacggcgcgctggagggcgtggaggccatcttcgccgtgcacgtgtcgcaccagcacccgacgtccgtggtcgggtccaggacgggggccctcctcgccggctgcggcttcttcaaggccgtgatacgcggcggcggcggcggcggcgaccgggcgtccgaccccgtcgtcctggccgccgcctccaccgtcatcagcctgcagggcatcgtctcccgcgaggcggacccgctggactcgcaggtggtgtcggtggcggtggtgaacggcggcagcgagcaggcccagcctcaggagcaggagctggtgctgggcggcacgttccgcgccttctccaacgccagcttctaccagctgcggcggcggatcgaggaggtggtcacggcgcaggcgcgcgtgcacgggtgcgccgcgtccgtcgacttcttcgagggccagagcttctacccgccaacggtgaacgacgcgcgcatgtacgcccacgtgcggcgcgtggcgaccgacctcctgggcgcgcaggcgtaccgcgacgtgccgcccatgatgggcgccgaggacttctccttctactcgcaggccgtgcccgccgggttctactacatcggggtgcgcaacgagacgctgggatccgtgcacacgggccactccccctacttcatgatcgacgaggacgtgctccccaccggcgcagccgtgcacgccgccatcgccgagaggttcctcgccgaacacgactccatcatgggcgtggccgcctccgacgaccaggacccctaggccgagcgcggtgggaaccgcgtggggagtttggccccgtcgctcggtcggcacggcagggatggtggcggaatgcgggctcgggctgctttttagattttgtggccgatgggctcttggtgggccgacctgtccgcgggctgacgtgcccacggttcaggttttttttccctccgtgttccgtttgggcgagcaaggaaaggaaccatgctgtgctggtgcagtgatgctgatgcaaatagtaggctgctctacgtatgtgtttttgtccctttttgggatgtcctgaaaactcatgatgtatagcacggtagctcctgcctacttggtagcaggaccaaaaaaaaaaaaaaaaaaaaaaaaaaaaaaaacmmaaaaaaaaaaaaaaaaaaaaaaaaaaaaaaaaaaaaaaggaaaaaaaaaaaaaaaac

SEQ ID NO: 87934 - protein, 481 aa, Zea mays
  misc_feature: Ceres CLONE 1575117
  misc_feature (148)..(462): Pfam Name: Peptidase_M20 Pfam Description: Peptidase family M20/M25/M40
  misc_feature: SWISSPROT Homolog: EC 3.5.1.32 Hippurate hydrolase
MDRGGHAALLLLLLALAVIPVTGAAGAAFLEEDAILGAVERAMMRGGGGKGAATANASGRHQHRRQRYGVGAPWREEIAGLAGRPELAAWLRSVRRRIHERPELAYEEVETSRLVRDELGALGVGFRHPVARTGVVATLGTGRPPVVALRADMDALPIQEAVEWEHKSRVPGKMHACGHDAHVAMLLGAASILKAREHQLKGTVKLLFQPAEESGCGAKRMIEDGALEGVEAIFAVHVSHQHPTSVVGSRTGALLAGCGFFKAVIRGGGGGGDRASDPVVLAAASTVISLQGIVSREADPLDSQVVSVAVVNGGSEQAQPQEQELVLGGTFRAFSNASFYQLRRRIEEVVTAQARVHGCAASVDFFEGQSFYPPTVNDARMYAHVRRVATDLLGAQAYRDVPPMMGAEDFSFYSQAVPAGFYYIGVRNETLGSVHTGHSPYFMIDEDVLPTGAAVHAAIAERFLAEHDSIMGVAASDDQDP

SEQ ID NO: 87935 - DNA, 878 bp, Zea mays
  misc_feature: Ceres CLONE 1575118
  misc_feature: Encodes the peptide sequence at SEQ ID NO. 87936
  misc_feature (702)..(702): n is a, c, t, g, unknown, or other
  misc_feature (726)..(726): n is a, c, t, g, unknown, or other
  misc_feature (736)..(736): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
ctccccgcggtggcggccgctctagaactagtggatcccccgggctgcaggaattcgtctcacccctagaaaaaagtccagtccacgccaccaaccgcgaggcgaaccaaaccaaccccctctccccaatcccgcgcgccctaccaaccatcggcgtcggcaatggcggccatggcgaccaaggccgccgcgggcaccgtgtcgctggacctcgccgcgccgtcgcgccgccaccaccgcccgagctcggcgcgcccgcccgtccgccccgccgtccgcggtctgcgggcgcctgggcgccgcgtgatcgccgcgccggcggcggcggcagcggcggcggcggtgcaggctggtgccgaggagatcgtgctgcagcccatcaaggagatctccggcaccgtcaagctgccggggtccaagtcgctttccaacaggatcctcctgctcgccgccctgtccgaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaaatgctgaactgcaatgcgggcattgacagcagctgttactgctgctggtggaaatgcnaactacgtgcttgatggagtaccnagaatgaggnagagaccccatggcgacttggttgtcggaatgaagcacgcgggnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnnn

SEQ ID NO: 87936 - protein, 162 aa, Zea mays
  misc_feature: Ceres CLONE 1575118
  misc_feature: SWISSPROT Homolog: EC 2.5.1.19 3-phosphoshikimate 1-carboxyvinyltransferase
MAAMATKAAAGTVSLDLAAPSRRHHRPSSARPPVRPAVRGLRAPGRRVIAAPAAAAAAAAVQAGAEEIVLQPIKEISGTVKLPGSKSLSNRILLLAALSEGTTVVDNLLNSEDVHYMLGALRTLGLSVEADKAAKRAVVVGCGGKFPVEDAKEEVQLFLGKC

SEQ ID NO: 87937 - DNA, 960 bp, Zea mays
  misc_feature: Ceres CLONE 1575119
  misc_feature: Encodes the peptide sequence at SEQ ID NO. 87938
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (23)..(23): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (91)..(91): n is a, c, t, g, unknown, or other
  misc_feature (101)..(101): n is a, c, t, g, unknown, or other
  misc_feature (125)..(125): n is a, c, t, g, unknown, or other
  misc_feature (159)..(159): n is a, c, t, g, unknown, or other
nccccacgannnnnnaagggaanaaggggnaaagannatgnaaaaaatangnnnntttnncccccttnnnaaaaactggagctcacgtggnggcggccgcnctacaagagaggagctcccgggcngcattacaacgacggggcctagaaaaaacacagnactcgcatctgctccgtcatgactcacgacaccgtagcttccttcctcgccgtcgccaaatgctgcaggccgcctccatgaggtgctagggttccctggccgacgccacgaccgtcgcacccggccgcctccgtccctgcgggccttcgccaccgccctcgccaaacgtcccgagccagggttcctcacagcttctcccaagcgccctccagtctcaccaacccttctgcggttctgcccttggcgccgcgcccatgagcctcaccgaggcgccgtccccgtccccgtcgtcgtcgagcgggagcgatgacttcgcggccttcctcgcctccgagctcgagctcacctccggtgctgactccgccttccctggtgacccctcctccgttttccccgccaccgacgacgagggcgaggatccggaggagctagaggttgaagccatagaacaaaacggtaccaaaaggcgtagagtagaggaacaatgccaagatcaaggaacatcagttaggcctgacaaaatccccactggcgcaactaaaattgttcaggttgaggcatgtccacatcctggacattttgggtggactttgcattatctgtggcaagccacaagacgaggcaagatgtttcagggaggtgccttttggggtacaacccacaaagggcctggagggcaagggaacccccagaaaaaggacaagggcaacgggggtggcctggatttgaaagaaacccggtgggcggtgaaaaagaaaaaataaggggccccccaattttggggaaccgggggaaacaaca

SEQ ID NO: 87938 - protein, 169 aa, Zea mays
  misc_feature: Ceres CLONE 1575119
MSLTEAPSPSPSSSSGSDDFAAFLASELELTSGADSAFPGDPSSVFPATDDEGEDPEELEVEAIEQNGTKRRRVEEQCQDQGTSVRPDKIPTGATKIVQVEACPHPGHFGWTLHYLWQATRRGKMFQGGAFWGTTHKGPGGQGNPQKKDKGNGGGLDLKETRWAVKKKK

SEQ ID NO: 87939 - DNA, 921 bp, Zea mays
  misc_feature: Ceres CLONE 1575121
  misc_feature: Encodes the peptide sequence at SEQ ID NO. 87940
aaagctggagctccccgcggtggcggccgctctagaactagtggatcccccgggctgcaggaattcgtctcacccctagaaaaaaagacccctcagccctcacacaagagacgcagctgcgagtccgacagccttatcctcctccccgtctccggctccaacccgcaagcgcggtaaggtatggcttcgacattcggtgccacttctactgtcggccttatggctgctacaacagggaagaatgtgcgccttcagaggagggtgaacttcacagtaagagcagctaaggagctgtacttcaacaaggatggctcagctatcaagaagctccagactggagtcaataagcttgcatacctaatcagaattacactcacaccaaagggaaggaatgttgttttccccaccaagtatggttctactaaaattgttaacgatggtgttacagttgccagagaggttgagctggaggaccctgtggagaacattggtgctaaattggtcaggcaagcaccagctaagaccaatgatctatctggagatgggacaaccacctctgaggtccttgcacaggggctgatcgctgagggtgtagacgttgtggcagctggtgctcatcctgttcacattactcgtggtatcaagaaaacagcgaaagcactagttgcagaaactacggaaatttgtctaaggacgccgaaaaatattgagccttgcagatgttgctgcatgtttagtgccgggcaacaaactacgaaaattgggtaattttgaaaagccacaggcccttgaaacaaaggttcggctcggaaagggaggagggtttccccgtcgaagaagaggggagggagattctggaaaaacttttctctctaagatttggggagagggggaaatgccaaatttgcattgggggcgtag

SEQ ID NO: 87940 - protein, 195 aa, Zea mays
  misc_feature: Ceres CLONE 1575121
MASTFGATSTVGLMAATTGKNVRLQRRVNFTVRAAKELYFNKDGSAIKKLQTGVNKLAYLIRITLTPKGRNVVFPTKYGSTKIVNDGVTVAREVELEDPVENIGAKLVRQAPAKTNDLSGDGTTTSEVLAQGLIAEGVDVVAAGAHPVHITRGIKKTAKALVAETTEICLRTPKNIEPCRCCCMFSAGQQTTKIG

SEQ ID NO: 87941 - DNA, 871 bp, Zea mays
  misc_feature: Ceres CLONE 1575123
  misc_feature (871)..(871): n is a, c, t, g, unknown, or other
ccccgcggtggcggccgctctagaactagtggatcccccgggctgcaggaattcgtctcacccctagaaaaaggttcgccaatctacttcgtcggcccaccccttttcccccgatcgatctctccttctcgctaagcgaactatcttgacctccctccctcgtgcgagattagccagtagaaagttccccgcttttcatccaggcacacttccaccacctcgctttgctgcttcactgcttgcttctgttgggcggagtgctaagaggacggcacgggagtcaagattcctcctccttaacctgccctttcgtgttgccgttgttggtggtttggtttgtgattgcggtggcgctggagttgcagtgtgtgtgaagcaaggggggcccccccccagtggattctgttctacttatcgattgctgctgatcctcactcccgtgcgacggcacaagcggcggtgaggggagagcatccgcggttgaccggccttggagggccccggtccgtctatggatcttgacgccccggtgccacaccccggcccggaactgaagtgctcagcaggggcgctttcttgcctggcactctcacgcgggctggagcctactgtggcagtcccctggtttgggtccggctaatcactgcaccggataagggggctgggaaataatggtggcctggaatgggagctgcctcctttagcccgaatgcgctatccggggttcccccagaacacgggccgccgggtaaaaccgagtaggccttcttgccggggggggtttatgggacccttacctaattcgtgaggaaaaaccataactggccttctcctgtctccctgtgaacaaaatgggagcgacagtctcccn

SEQ ID NO: 87942 - DNA, 855 bp, Zea mays
  misc_feature: Ceres CLONE 1575127
  misc_feature: Encodes the peptide sequence at SEQ ID NO. 87943
  misc_feature (839)..(839): n is a, c, t, g, unknown, or other
  misc_feature (840)..(840): n is a, c, t, g, unknown, or other
ctggagctccccgcggtggcggccgctctagaactagtggatcccccgggctgcaggaattcgtctcacccctagaaaaaatcgcccgtctcccccgcgatcaagctgaccagagccggcaaccgatggtggtggtggcggtgggagggggcggaggcggcggctgggggacgtgggaagagctggtgctgggcggcgcagtgctccggcacgggggcgccgcgtgggccaccgtcgccgaggagctccggacccgttccccgtgcaccttctcggccgaggaatgtgaagcaaaatttgcagagatacagttgcggtactccgcatgcaatgcttggtttgaagagcttcgtaagcagagagttgctgaactgaaaagggaattggagaagtcggaaaattctatcggatccctccaatctgtgattcaaagcctcagcaatagcaaacatgttgacgggagttctgaataccacaccagtcatactgaatcatgtccccgctctgaaaatacagcagatactaattcctcaggtaaagaaacatccagggatagatcatcagctgctagtttcacagaggaggcaagcaacagtcagaaatctcagaaagtgcagcagtgtgatactgattcaattcaagctatcaatccatcaccagatgagtcatatccccaggcccaagttgaaaaggtcggtcccaaagatggcttgctttggggttctagaaaacaaagaggagggagagctagaaggacacttctgaaaggtgggtgatagtagcggggaatggtgagcctacatctacagcattcataccagagggagggttcgtctaanngctgcatgaagaact

SEQ ID NO: 87943 - protein, 216 aa, Zea mays
  misc_feature: Ceres CLONE 1575127
MVVVAVGGGGGGGWGTWEELVLGGAVLRHGGAAWATVAEELRTRSPCTFSAEECEAKFAEIQLRYSACNAWFEELRKQRVAELKRELEKSENSIGSLQSVIQSLSNSKHVDGSSEYHTSHTESCPRSENTADTNSSGKETSRDRSSAASFTEEASNSQKSQKVQQCDTDSIQAINPSPDESYPQAQVEKVGPKDGLLWGSRKQRGGRARRTLLKGG

SEQ ID NO: 87944 - DNA, 812 bp, Zea mays
  misc_feature: Ceres CLONE 1575128
  misc_feature: Encodes the peptide sequence at SEQ ID NO. 87945
  misc_feature (686)..(686): n is a, c, t, g, unknown, or other
aagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaggtacccggcgaagacctttctccacgacgtcgggcttncgcggcatcggctacgagggcaaccggctacttctacgccaactggcaaggacttcaaagttccccaaactttcggcatcaggaaaggccgccaaacgccaagaatgtggaagacaagtcccgcac

SEQ ID NO: 87945 - protein, 185 aa, Zea mays
  misc_feature: Ceres CLONE 1575128
  misc_feature (144)..(144): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCRYPAKTFLHDVGLXRHRLRGQPATSTPTGKDFKVPQTFGIRKGRQTPRMWKTSPA

SEQ ID NO: 87946 - DNA, 855 bp, Zea mays
  misc_feature: Ceres CLONE 1575130
  misc_feature: Encodes the peptide sequence at SEQ ID NO. 87947
  misc_feature (313)..(313): n is a, c, t, g, unknown, or other
  misc_feature (374)..(374): n is a, c, t, g, unknown, or other
  misc_feature (382)..(382): n is a, c, t, g, unknown, or other
  misc_feature (383)..(383): n is a, c, t, g, unknown, or other
ctggagctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcangcgacgaaagctcgccaagtggtatgggtctgacaggaggatctacctgccggatgggctngtggaccnngtcggagtgcccgaagtactcaccggagaagtccctggagactatggctacgaccctttttggcctgggccagaaacccgaggaacttcgccaagtacccaggcctacaaactgattccatgccaaaaggggccatggctcggggccccctgggccttttcattcccaaaaggcttggcaaaaagtttcgggccttaaatgggggcccctaaaggtgtttttggttcaaaaaaacgggggcccttggttccggggaagggaaaaacccctttaaaaaaattttggggaaaaagaatcccccataaaaactgggtgggggggggccgggtaacccccgaaagggtattcccccttttggggggggggccgaaaaataatatcccggggacccccacaggggggggtggccctctagagggaaaaaatttgtgcccccccccggggggggccgcttttaaaaacaccccggggg

SEQ ID NO: 87947 - protein, 147 aa, Zea mays
  misc_feature: Ceres CLONE 1575130
  misc_feature (59)..(59): Xaa is any aa, unknown, or other
  misc_feature (82)..(82): Xaa is any aa, unknown, or other
MAALAPSKILGTQLNFAGSSRYATAAPTAGAQKIVSLFSKKPAQKPKPAAVSSSSPDIXRRKLAKWYGSDRRIYLPDGLVDXVGVPEVLTGEVPGDYGYDPFWPGPETRGTSPSTQAYKLIPCQKGPWLGAPWAFSFPKGLAKSFGP

SEQ ID NO: 87948 - DNA, 865 bp, Zea mays
  misc_feature: Ceres CLONE 1575133
  misc_feature: Encodes the peptide sequence at SEQ ID NO. 87949
aaaagctggagctccccgcggtggcggccgctctagaactagtggatcccccgggctgcaggaattcgtctcacccctagaaaaaactgacaggggtcatgtacaattgcctatttcttctatgcatctcctctgctccctcaaccacatcgcccagagggcgttcacgccttcccaggtacggaaatagggacggacagaaagataaaaacaaggtacagtctacgctgcacctcctcttttccttctctgtacggagatgactgctcacccgatcctagaacacgagagaccccgtctatctctctctttcttgctcttcagtcttaatacgagcttcgcactgttggattctccctctacgattaggtggttccgctgcttgtgaaccatgattttgtctagctcttcgatatgactacgacaagccacgacgacaatccgtggcgctttctgtcgatgctgagaggctctcaagacattcacgaagtagagttagagaggcggttcacgctcttcaacgacttcatccagagggcgtcgcgtgtggtttctccaggcgatcgtgctatgggccgcggcgacttctttgtcgacctcaaggtctaggcgaatcggaatctcactttggctgctgccctggccacctccgtatctgatatagaccgtgtaagcaacggtggcttgggattggaaccgaactccgtctcgtcgttgcatcgagctacatcggcaagtactgacacacagaagctgggtcatatccaagtcgctagccttatagagtcatcggcaaagaaagggactacagagctcaatctccgggggtagctggtcggacaagtttagtggcttcctgtcctgc

SEQ ID NO: 87949 - protein, 64 aa, Zea mays
  misc_feature: Ceres CLONE 1575133
MTTTSHDDNPWRFLSMLRGSQDIHEVELERRFTLFNDFIQRASRVVSPGDRAMGRGDFFVDLKV

SEQ ID NO: 87950 - DNA, 937 bp, Zea mays
  misc_feature: Ceres CLONE 1575136
  misc_feature: Encodes the peptide sequence at SEQ ID NO. 87951
ctccccgcggtggcggccgctctagaactagtggatcccccgggctgcaggaattcgtctcacccctagaaaaagacgggcgagagagcggaagcgacgactagctctgcggcctctgccccaagcgcctacgatgggtgccggtgctactgccagggaccaggaggctgctaccggccaccaccatgggaggaagcctcatggcgcaactgtggagtacgcgcaggacgggtccgtggacctgcgcggcaaccccgtgctccgctcccagagtggtggctggaccgcctgctccttcatcgacgtgtacgagctgttctagcggatggcctactacgggatctcgcccaacctcatcatctacctgacagacgagctccaacggggtaccgccccacccctccaacaacgttaccaagtggtccggcaccgtcttcatcacgactctgctcggtgcctaggtcgcagaggcctaccttggccgctactgggaccttcgtcgtccggctccaccatttacctggggggggagagtgcttgctggtgctgtacttcctcggggcctggccctgaaagccggctgccctgcgggtaccgggagggtctgttccccacagggacttcgggcgcttgcatcttcggggacgtgtcattttggcgggggaaataaaattctttggcccttggggaacaagggcgggtacccaaggccccacattatttcgacaatcttgggggggaaccaaatttgaagtatttttcaaccccctttggaagcggaacaccccaatcttgttcctttcttcaaatggtgggtgatggtttcaccataattttcctggggaaattcttcttttttatttcaacgcgggcatggggtgaacactgggcggagagaacccttggtcttgggttctggtgggctaggggtgttctc

SEQ ID NO: 87951 - protein, 62 aa, Zea mays
  misc_feature: Ceres CLONE 1575136
MGAGATARDQEAATGHHHGRKPHGATVEYAQDGSVDLRGNPVLRSQSGGWTACSFIDVYELF

SEQ ID NO: 87952 - DNA, 785 bp, Zea mays
  misc_feature: Ceres CLONE 1575137
  misc_feature: SWISSPROT Homolog: EC 5.2.1.8 Peptidylprolyl isomerase
aaagctggagctccccgcggtggcggccgctctagaactagtggatcccccgggctgcaggaattcgtctcacccctagaaaaactttgggagaaggggatctgaactaggtccaactcatgttttagttgttcgtggcttggatgaaaatgctgatgaggaaatgcttcggtacgaatttgctaagcacgcaccaataaaggacatccgccttgttcgggataagtttactcatgtgtctagaggttttgccttcgttcatttccattcggtggaagatgctacgaaagctctggaagctacaaacgggattacacttgagaaaaacggtcaggttttgcgtgtagcatatgctaaaagtacacatgggacttgcatcaggggggtttctcaattcaaaacagccttggccgccacctgcccattgagggctgccattcttttgcctccagcagtaattgaagccccttagggtttgggggctcccaaaaagaagtaccaatttcctggagtgacccaaacacggaaaaccaccccccctcctttagaaattctcccaaaaaaaaaatgtggggggggcccccacggcccacaggttcgggggggaatttttgtttttttggggggaaaaaaaaaaaaaaacccgggggggtttccccccccccttgggggaatttctcccgcccccaccctcgggggggtatttcctttttttttttttggggggggggggggaagaaactctctgtgggggggggccctcttttttaaaaaaaaaaagaaaa

SEQ ID NO: 87953 - DNA, 869 bp, Zea mays
  misc_feature: Ceres CLONE 1575142
  misc_feature: Encodes the peptide sequence at SEQ ID NO. 87954
  misc_feature (869)..(869): n is a, c, t, g, unknown, or other
tggagctccccgcggtggcggccgctctagaactagtggatcccccgggctgcaggaattcgtctcacccctagaaaaacaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcacatcttcgtcaagaccctcactggaaagactatcaccctcgaggtggagtcttctgacaccatcgacaacgtcaaggccaagatccaggacaaggagggcatccctccggaacagcagcggctcatttttgctggcaagcagctcgaggacgggcgcacgctgggcgactacaacattcaggaggagagcaccctccactgggtgttgcgtctcaggggcggcatgcagatcttcgtgaaaactctgactgggaagactatcacccttgaggccaggcttccggaaacatttggacatgccaaggcccagatccaggaaaagggagggctttccttccggaacggaaggggttcttttttgcccggaaacattttagggaaggggcccccctttgccgaattcaaaatttggaagggaggcccccctcccttgggtgcccggccccagggggggggaaggaaaattttcggn

SEQ ID NO: 87954 - protein, 235 aa, Zea mays
  misc_feature: Ceres CLONE 1575142
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMHIFVKTLTGKTITLEVESSDTIDNVKAKIQDKEGIPPEQQRLIFAGKQLEDGRTLGDYNIQEESTLHWVLRLRGGMQIFVKTLTGKTITLEARLPETFGHAKAQIQEKGGLSFRNGRGSFLPGNILGKGPPFAEFKIWKGGPPPLGARPQGGGRKIFG

SEQ ID NO: 87955 - DNA, 927 bp, Zea mays
  misc_feature: Ceres CLONE 1575145
  misc_feature: Encodes the peptide sequence at SEQ ID NO. 87956
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
aaagctggagctccccgcggtggcggccgctctagaactagtggatcccccgggctgcaggaattcgtctcacccctagaaaaaaaagctctccccttcccacctcgtccccctcgacctctccacatcctggtgctgcacgccccacggtctcggcggccacgccccacactcctcgtcctcgtcctcctcctcgcacccctcctccccggcccgcgccgccgcccatcacatggacccgccgcccaccagctctaccgtggcctcctcctacgccactccgccccagccttcctacgcgccctcctaccctaccagctacaccaagttcaactccgcgctcaacgcggggttgctcaatcccatgtccccgccgccgctgccacttgacaagacgcgctccagccccacactcttcgacatgatggccaacgagcaggactaccacccccgcaccgccgccggcatccactccatccccgccccgccccagccgcaccagctcccgcccgcgcgctccatggacaggcagatgctgctccaggaccgcatcgccgacctcatcggcagctgtagccccgggaaccagttcaacgacgccgactcctccgacgtccgcctcaccctcagctccaaggacggcctctccgtcacgctctggttacgccacaatctccgcacagagtctcgcgccatgtcgacgctgtcagcacacacctgccaatctcaattcactgacactcaggacgcaacctgcgtatgatcagatccgagtatcgaagagctacagcactaacgtttgatagctgaaaaagctaactaccttcagggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87956 - protein, 176 aa, Zea mays
  misc_feature: Ceres CLONE 1575145
MDPPPTSSTVASSYATPPQPSYAPSYPTSYTKFNSALNAGLLNPMSPPPLPLDKTRSSPTLFDMMANEQDYHPRTAAGIHSIPAPPQPHQLPPARSMDRQMLLQDRIADLIGSCSPGNQFNDADSSDVRLTLSSKDGLSVTLWLRHNLRTESRAMSTLSAHTCQSQFTDTQDATCV

SEQ ID NO: 87957 - DNA, 920 bp, Zea mays
  misc_feature: Ceres CLONE 1575151
  misc_feature: Encodes the peptide sequence at SEQ ID NO. 87958
  misc_feature (370)..(370): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (872)..(872): n is a, c, t, g, unknown, or other
  misc_feature (873)..(873): n is a, c, t, g, unknown, or other
  misc_feature (885)..(885): n is a, c, t, g, unknown, or other
  misc_feature (886)..(886): n is a, c, t, g, unknown, or other
aagctggagctccccgcggtggcggccgctctagaactagtggatcccccgggctgcaggaattcgtctcacccctagaaaaaaattaaagaaaaaggaaattttcttgggcgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactancacatccaaaaggagtcaactcttcatttggtcctcaggcttagggggtgaaccatgatcaaggtcaaaactctcactgggaaagagatcgagatcgactttgaacccactgactcgattgacgggatcaaggaccgtggttaaaaaaaagaaggcattccttccgggcagcaaaggctcatctttgctggtaaacactttgcttaataacaaacccccaagggcctccccctccgggggggggatcgggcccccactttgtcccttgccctgagggggggggttattttcctaaccctggaaaaacccgcccccaaaaaaccttgttgtttgggcgcccaaaaatgggcgcccccttttttgtaatttccggggggaaaaaaaaaaaaaattaaatttttcccccccgccccccggaggggggggcgtccccccccatttttgtggggaggggagagtttctcccccacccccccaaaccnnnnnnnnnnnnnnnnaaaannaaaaaaaaaaannccaaaaagggggggccccccccctcctccaaaaa

SEQ ID NO: 87958 - protein, 75 aa, Zea mays
  misc_feature: Ceres CLONE 1575151
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (59)..(59): Xaa is any aa, unknown, or other
MQIFVKTLTGKTITLEVESSDTVDNVKAKIQDKEGIPPDQQRLIFAGKQLEDGRTLADXHIQKESTLHLVLRLRG

SEQ ID NO: 87959 - DNA, 864 bp, Zea mays
  misc_feature: Ceres CLONE 1575152
  misc_feature: Translation starting site: 193
  misc_feature: Pfam Name: Glyco_transf_29 Pfam Description: Glycosyltransferase family 29 (sialyltransferase)
  misc_feature (487)..(487): n is a, c, t, g, unknown, or other
  misc_feature (605)..(605): n is a, c, t, g, unknown, or other
  misc_feature (610)..(610): n is a, c, t, g, unknown, or other
  misc_feature (663)..(663): n is a, c, t, g, unknown, or other
ctggagctccccgcggtggcggccgctctagaactagtggatcccccgggctgcaggaattcgtctcacccctagaaaaaactcagtattccacgcttgacactccgtgacggacgcgcgccctttcccctcttctgcgactcattccggagcgcgctgcctccgatccgcggcaccgcgtcgcgtccgccgatgacgagggcgcacctgccggcggcggcgcagcggcggccgacggtggcgctgcttctgggcctggcgctcgccttctgcctcgccgtcctctccatccagtcctccttcttcgccgccccaggggcgccgggcaggaggctggatctggacgccgacgacgtgcgcgagctcgcggggttccagtcccgcgtccagcagtgcgtggctagcagaggacttggtctcacagcgcatattattgatcactgctagctggtccatagatttcctgaagggaccaacagcacctggntatatgctcagttcgagatttttgaacctctagaatacaaatatgatgtctgtgaaactagtctattggtgggaacagtaccgcaacatgactactgtattgacaagggaatacttgnatgtnaggccggatggattgttcgaattatcacctaaaaggatcgacagctgaaaccnaaatttttttccgcccacttttcctaaaaggggaaacaaccctcccccctttgggaccaattctttggatttaaaattttgccggggggtcttgaaaagggttacccccccctctgtggggaagacttttaaaaactttaatggctgggaaaacccccttttctttccccccgttttccaaaaatgggggattttgtggga

SEQ ID NO: 87960 - DNA, 835 bp, Zea mays
  misc_feature: Ceres CLONE 1575161
  misc_feature: Encodes the peptide sequence at SEQ ID NO. 87961
  misc_feature (660)..(660): n is a, c, t, g, unknown, or other
  misc_feature (756)..(756): n is a, c, t, g, unknown, or other
  misc_feature (757)..(757): n is a, c, t, g, unknown, or other
  misc_feature (762)..(762): n is a, c, t, g, unknown, or other
  misc_feature (765)..(765): n is a, c, t, g, unknown, or other
aagctggagctccccgcggtggcggccgctctagaactagtggatcccccgggctgcaggaattcgtctcacccctagaaaaagccccccattcctttccccactctcatgccaccgccatcgcctcctcccactccttattgccgccgctgccctgctccaaccccccgcctcctctttcctcgcaagaccacgtcctcatccactacatccaccagctagacgagcaagaagccgccaccatggtccgcaagcgccccgcgcccgacatggacctcccgccgccgcgccgtcacgtcacgggcgacctctccgacgttacggccgcagccgccgccgctggtggtcctggcgcgccgtcctccgctagcgcgcagctacccgcgctgcccacccagctccaccagctgccccccgcgttccagcaccacgcggcggaggtggacgtgcccccgcaaccgcacccgccggcccattcgcaggcgggcggcgaggcgcccgcgtccacgaccgcgtgggtggacggcatcatccgcgacatcatcgggagcagcggcggcggcgctgtctccatcacgcagctcatccacaacgtccgcgagatcatccacccctgcaacccaggcctcgcgtccctcctcgagctccgccctcgttccnttctcgccgccgaccccgccccgctgccgcagcagcagcgcgctctcctgcacggcgctccggccgccgccgcggggctggggctccctctcccgnncacgnttncttgacagcgcccgcacgagcctgcgccgcggtggcagcagcaacagcagggagagccgcattcggcgcc

SEQ ID NO: 87961 - protein, 253 aa, Zea mays
  misc_feature: Ceres CLONE 1575161
  misc_feature (220)..(220): Xaa is any aa, unknown, or other
  misc_feature (252)..(252): Xaa is any aa, unknown, or other
AGAPRGGGRSRTSGSPGLQEFVSPLEKAPHSFPHSHATAIASSHSLLPPLPCSNPPPPLSSQDHVLIHYIHQLDEQEAATMVRKRPAPDMDLPPPRRHVTGDLSDVTAAAAAAGGPGAPSSASAQLPALPTQLHQLPPAFQHHAAEVDVPPQPHPPAHSQAGGEAPASTTAWVDGIIRDIIGSSGGGAVSITQLIHNVREIIHPCNPGLASLLELRPRSXLAADPAPLPQQQRALLHGAPAAAAGLGLPLPXT

SEQ ID NO: 87962 - DNA, 850 bp, Zea mays
  misc_feature: Ceres CLONE 1575163
  misc_feature: Encodes the peptide sequence at SEQ ID NO. 87963
  misc_feature (736)..(736): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
caaagctggagctccccgcggtggcggccgctctagaactagtggatcccccgggctgcaggaattcgtctcacccctagaaaaaagctgcagagagcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctngtatggggcttctgcttgcataagggtgtactatattgcagtgatctgccnnnnnnnnnnnnnnnnnnnnnnnnnnnnnnnnnnnnnnnnnnnnnnnnnnnnnnnnnnnnnnnn

SEQ ID NO: 87963 - protein, 194 aa, Zea mays
  misc_feature: Ceres CLONE 1575163
  misc_feature: SWISSPROT Homolog: EC 3.6.1.1 Inorganic diphosphatase
  misc_feature (188)..(188): Xaa is any aa, unknown, or other
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAXMGLLLA

SEQ ID NO: 87964 - DNA, 875 bp, Zea mays
  misc_feature: Ceres CLONE 1575165
  misc_feature (593)..(593): n is a, c, t, g, unknown, or other
ctggagctcaccgcggtggcggccgctctagaactagtggatcccccgggctgcaggaattcgtctcacccctagaaaaaaattgtgattctgatacttcatcattataaaccctagagtttggtggggattgttggatcttttatgggcttggcccatttattgaataaactctatggtgtgtaatggtggagaataccaatagtaacacattggaagtccaagggtcttttgccttgacttatatggtgggatttattccacttaacttgagaagtcaagaaatggacaagggcgtgccacgcgcgcgccgccgccgccggccgggccgggccgggcgtggcgtggcgaggcgaggcgaggcgaggcaggcaggcaggcgagcgggcgggcgtggtgtggttgtgttaatttttagcactcactaaccgcgtacgttagccgagtgactctgtctcttcgtctgccgagtgaccctgtctcttcgtcagccagccgagtgacccttctccttcagctgccgactttatgcgtgactccgcgagagctgggcgactcatggcataactcggctagagctggccgactcttgntgtgactcggcgacctttctcctttaagctcccttctgcaaaaggtaaattgaggagcacccctgttccctggtaccgccgaaaaaccctttcagtctccaaatccacccgccaaaggagggaattcccttcccggactttgcccccccagaataaccaaaaggaaggtgcctccaagcccggggccttttaaaattttccccgggaatcgcaaataagttttttggggagccttttccccattgccccaaaattttttaaataaaaaagagaagggcccaa

SEQ ID NO: 87965 - DNA, 799 bp, Zea mays
  misc_feature: Ceres CLONE 1575166
  misc_feature: Encodes the peptide sequence at SEQ ID NO. 87966
  misc_feature (667)..(667): n is a, c, t, g, unknown, or other
ctccccgcggtggcggccgctctagaactagtggatcccccgggctgcaggaattcgtctcacccctagaaaaatagaaaaagtgactgacctgtcgtcggactcctctccttttccagatcactcacatttcccgcatccactgaatttaacacaagatccccgccagcgccgccgcgcgaccaccccttcctaaaccccgacgaccgccaaccatggccttcaccgctaaaccctactgctccaccaccgccaaaccgcccacccccgccgcccaccgctcgccgtccggcccgtccccctccatctccgtccgcgccgccgccgtatccccccgcgcccggcactcagtctatggcctctccgccgccggcaacgcgtcctccagcaccgtccgcctccgcgcgctggcccagcgcacccgggcgcagccgcagcagcctccgcggcggcggcccgagtacgtgccgaaccgcatcgacgaccccaactacgtgcgcatcttcgacaccacgctccgcgacggggagcagtcgccgggcgccaccatgacgagcgccgagaagctcgtcgtcgcgcgccagctggcccgcctcggcgtcgacgtcatcgaggccgggtttccggactcctcccccgacgacatcgacgccgtgcgcatcatcgncatcgaggtcggcaacccgccgccgggggacgacgggggcgcccacgtgcccgtcatctgcgggctctcgcgctgcaacggatggaaatccacgccgcgttgggagccgtcaggcacccgcgggagcccagg

SEQ ID NO: 87966 - protein, 194 aa, Zea mays
  misc_feature: Ceres CLONE 1575166
  misc_feature: SWISSPROT Homolog: EC 2.3.3.13 2-isopropylmalate synthase
  misc_feature (151)..(151): Xaa is any aa, unknown, or other
MAFTAKPYCSTTAKPPTPAAHRSPSGPSPSISVRAAAVSPRARHSVYGLSAAGNASSSTVRLRALAQRTRAQPQQPPRRRPEYVPNRIDDPNYVRIFDTTLRDGEQSPGATMTSAEKLVVARQLARLGVDVIEAGFPDSSPDDIDAVRIIXIEVGNPPPGDDGGAHVPVICGLSRCNGWKSTPRWEPSGTRGSP

SEQ ID NO: 87967 - DNA, 829 bp, Zea mays
  misc_feature: Ceres CLONE 1575167
  misc_feature: Encodes the peptide sequence at SEQ ID NO. 87968
  misc_feature (138)..(138): n is a, c, t, g, unknown, or other
aagctggagctcaccgcggtggcggccgctctagaactagtggatcccccgggctgcaggaattcgtctcacccctagaaaaaatacctcaccttcctttcctcctcccgtcctccatcaaaagaaggcagggaaagnatctgatctggggggtgagagagcaggaggagaaagccaagccattgccctcccctcttgaaggcttggagcttggttctacatcctcttctcttcccctccgtctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcaagagcaacccccacacccacctcatggggcctgaggaagcggctgtccagcttctccggcaagatccagcccatctcctccgcgtcggccgcccgagtggggcgttccgccgctccaagtcggcgcccctcccttcggggcgcctttcgccccggggggggcggctcccctgaaagcaattggtgggcaattgggggccgttcggctgggctccctgtccccaaaaagccccgggggttcccgcgggcgacctcccaacattaaacccagggagggaagtttgcccctccccttggggcccccccaaaacaggggggcccccctggggccccagcttccttccttttaagaataacggggcccggggggttccgcccccacccctttttgggaggttgggggggaccttggttttcccccaacaacggag

SEQ ID NO: 87968 - protein, 87 aa, Zea mays
  misc_feature: Ceres CLONE 1575167
MATILENIQKARFLPTRPLKDELPTFQGGGKSNPHTHLMGPEEAAVQLLRQDPAHLLRVGRPSGAFRRSKSAPLPSGRLSPRGGRLP

SEQ ID NO: 87969 - DNA, 1120 bp, Zea mays
  misc_feature: Ceres CLONE 1575168
  misc_feature: Encodes the peptide sequence at SEQ ID NO. 87970
  misc_feature (1039)..(1039): n is a, c, t, g, unknown, or other
  misc_feature (1116)..(1116): n is a, c, t, g, unknown, or other
  misc_feature (1118)..(1118): n is a, c, t, g, unknown, or other
ggccgctctataactagtggatcccccgggctgcaggaattcgtctcacccctagaaaaaaaaatctccccttcccacctcgtccccctcgacctctccacatcctggtgcagaacaccccacggtctcggggagaacaccccacgctcatcgtcctcgtcctcctcctcgcacccctcctccccggcccgcgccaccgcccatcacatggacccgccgcccaccagctctaccgtggcctcctcctacgccatccgccccagcctatcctacgcgccatcctaccctaccagctacaccaagttcaactccgcactcaacttggggttgctcaatcccatgacccccccgcttcaaaacactaaacaagacacaccaccgggtatacaaatcttagacatgaaggccaacgagtaaagactaccgagccccgaggacgggcgtccgggcatccaggttcaatcatgcacctgcgctttttattcgccaccaaaacttcccgacatcatcgccgcttcgcatgggatcaaggtaaagatggctagcctggccgggaacctccatatccccgaaaccctccggtcgcacatattatttatggctctcacctgggaaagagaaatttttcgagtcgcagcaacctgaaaaaacaccttcagaagagataacggggcccaaaatacgccggtccagtagatgctatatgggcaatatagacttatttggttgaccggccaaacatgatgtctcttgcgggtattcccacaaggcgtccacaattagaattctgcgagccacgcccactcaatccaaagggattgttcttctcccaccattacaaaaaacacaggtgcccgtggtagctaattggtgggtcctttgttgacctacaggaaagaagaagaagggggtcgtcgggcacatcttgacttgggacatatgattctcacgccattgtatagaactacagtatctacaaggtagaggagcgtgctcagaaatacagggtggcgcctgactaatacagtgagcggcgccngagcacgtctcttccgataggtagtaaccactctctcccacgcctggttggctggaagcgtggggaggggcaaagcngntg

SEQ ID NO: 87970 - protein, 138 aa, Zea mays
  misc_feature: Ceres CLONE 1575168
GRSITSGSPGLQEFVSPLEKKISPSHLVPLDLSTSWCRTPHGLGENTPRSSSSSSSSHPSSPARATAHHMDPPPTSSTVASSYAIRPSLSYAPSYPTSYTKFNSALNLGLLNPMTPPLQNTKQDTPPGIQILDMKANE

SEQ ID NO: 87971 - DNA, 812 bp, Zea mays
  misc_feature: Ceres CLONE 1575169
  misc_feature: Translation starting site: 281
  misc_feature: SWISSPROT Homolog: EC 5.1.3.2 UDP-glucose 4-epimerase
  misc_feature (628)..(628): n is a, c, t, g, unknown, or other
  misc_feature (692)..(692): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (786)..(786): n is a, c, t, g, unknown, or other
aaagctggagctccccgcggtggcggccgctctagaactagtggatcccccgggctgcaggaattcgtctcacccctagaaaaacactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcacgggcggggcgggctacatcggtagccacgccgtgctgcagctcctcctcgcgggcttccgcgccgtcgtcatcgacaacctcaacaactcctccgagctggccgtccgccgcgtcgccgcgctcgcgggggaccactcccgtcacctctctttccacagattgatctccgtgactagggagcactggaaatggtttttgcttctacaagaattgaagctgtcattcacttcgctggattgaaagctgtggggtgaaagcgtacagaagccattacttttattatgacaaccnacgtcatttggcacgataaaatcttctagaaagttaatgtcttgttcacggttgcaagaagttnggtggttctcatcatcaggctgcaggtttattggattcacccaaaaacttccccttggacggaaaatttttcccttttcttccaaannnaatcnttactagtcatcgttgcttgctcagc

SEQ ID NO: 87972 - DNA, 922 bp, Zea mays
  misc_feature: Ceres CLONE 1575170
  misc_feature: Encodes the peptide sequence at SEQ ID NO. 87973
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
ctggagctcaccgcggtggcggccgctctagaactagtggatcccccgggctgcaggaattcgtctcacccctagaaaaagtacttggagggcagctgggcaggtgaaaggaagaggaaagagggcgagtgcgacgggaggcgcaatgcggtggagatctcccgccgtgctgcggctgcagctgtggctgctcgccgtctccgcgtcgttggctgccctcggtgttctcgcggctgatcttagcaaagaaccatttactatccgtataagctgtggaagctttgacgatgtccggacggagcctacgaacacattgtggtacagagactttggttatactggaggcaggttcgctaatgccacccggccaagctttatcgttcctcctcttaaaacgcttcgatatttcccgctatctgatggccctgaaaaatgctaccacatcaacaatgttcccaggggcccactatcaggttagacttttcttggttcttgccgggacaacccctattttggaagggggcccaatttccgaatgtttgggttggggggaccttgtgttccctctttttccttggggggtggaacccccaccaaaaaaaaaaattttttccaactttttggtttttttccccaaaaaccacccataaaggttggccccaaaaacgcgggggtgggggcccccccccttttttttgggggggtctcccaaaaaagaaagaaagcctctatttttttcccccccggaaaggggaggttttcacacaaggggcgtttnnnnnaaaaaattttttttctaaagaaccccccttttttaaaaaaaaaaaaatagtcttcccgggggggggggaacacacctggggggaaaaaacaaatttcccccccgcggggggggggagacacacccccgccgggggggagg

SEQ ID NO: 87973 - protein, 110 aa, Zea mays
  misc_feature: Ceres CLONE 1575170
MRWRSPAVLRLQLWLLAVSASLAALGVLAADLSKEPFTIRISCGSFDDVRTEPTNTLWYRDFGYTGGRFANATRPSFIVPPLKTLRYFPLSDGPEKCYHINNVPRGPLSG

SEQ ID NO: 87974 - DNA, 877 bp, Zea mays
  misc_feature: Ceres CLONE 1575174
  misc_feature: Encodes the peptide sequence at SEQ ID NO. 87975
  misc_feature (832)..(832): n is a, c, t, g, unknown, or other
aaagctggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgttagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttcctgttccccactggcaacgctaccgaagaggagctgaagacgggggcgtcgccgcctgcggacatgatggtggcgagcgncgcgacgttcccgtacgtcgaagcggcggatgagcgccggcatgt

SEQ ID NO: 87975 - protein, 232 aa, Zea mays
  misc_feature: Ceres CLONE 1575174
  misc_feature: SWISSPROT Homolog: EC 3.2.2.22 rRNA N-glycosylase
  misc_feature (218)..(218): Xaa is any aa, unknown, or other
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVTRPAAAAGDGEDPGVAAWRARDLDEAISSLFLFPTGNATEEELKTGASPPADMMVASXATFPYVEAADERRH

SEQ ID NO: 87976 - DNA, 865 bp, Zea mays
  misc_feature: Ceres CLONE 1575175
  misc_feature: Encodes the peptide sequence at SEQ ID NO. 87977
aaagctggagctccccgcggtggcggccgctctagaactagtggatcccccgggctgcaggaattcgtctcacccctagaaaaaacacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgaggccgacgcgcgcaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatattcttctcggttgctactcagctaggcagatatgttatcactatgatgagcagcggtgttgtactggggggttggattccagctgtcaggcgggagacggccaaatgaacgaactaatttggtatagctgggcttggggggggtgataacgggcacaaagaaagggggcaaaacggggtcctagaaggaacactggcaaagctgggaccttccccaaggggcgtccaaaaactgggaaaccccaaaagaggttttaggaaaaaagcgcctttgcctcccgagaagttttcccttctttttttttggagaaaacccggggtttggtat

SEQ ID NO: 87977 - protein, 145 aa, Zea mays
  misc_feature: Ceres CLONE 1575175
MAAAAAAAVAHLSIHGRLRRSPEHRPSITTTTTSSSSPSAHRPSLLRCRAFKQEASDGDPAEADARKRRKGPLYKLKAAIQGLAGSRSAAAEVYGGEYQYQRAVEKAEEIFFSVATQLGRYVITMMSSGVVLGGWIPAVRRETAK

SEQ ID NO: 87978 - DNA, 894 bp, Zea mays
  misc_feature: Ceres CLONE 1575177
  misc_feature: Encodes the peptide sequence at SEQ ID NO. 87979
  misc_feature (810)..(810): n is a, c, t, g, unknown, or other
  misc_feature (816)..(816): n is a, c, t, g, unknown, or other
  misc_feature (822)..(822): n is a, c, t, g, unknown, or other
  misc_feature (823)..(823): n is a, c, t, g, unknown, or other
aaagctggagctcaccgcggtggcggccgctctagaactagtggatcccccgggctgcaggaattcgtctcacccctagaaaaagctcgctcgcccgccaccgagagacgacgctctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcggaagaaggccatgcgggaggccctggagaagatcaaagcaaagttgatgctgatgggcttcatctcgctgctcctcgccgtggggcagacgcccatctccaagatatgcatcccggccaaggctggcagcatcatgctgccgtgcaagccgccgaaaggcgccgccgccgccgccgacgacgacaagagcgacggccgccggagactcctctggtacccgccgtaccctggatacgatgagcccgggcaccaccgccgtttcctcgccggcgcggctccggacgacaactactgcagtgaccaaggcaaggtgtccctcatctcctcggccggcgtccaccagctgcacatcttcatcttcgtgctcgcggtggtccatatcgtctacagcgtcgacaccatgacgctggggcgtctcacaatgaggaaatgaatgaaatgggaatcgnagaccnactccnntggatacagtacgcaacgaacccttcacgttccgggtcacgcaccgacgtcgatcgtgaaagcgccactgg

SEQ ID NO: 87979 - protein, 190 aa, Zea mays
  misc_feature: Ceres CLONE 1575177
  misc_feature (5)..(191): Pfam Name: Mlo Pfam Description: Mlo family
MAGGGGGRDLPSTPTWAVALVCAVIVLVSVAMEHGLHKLGHWFHTRRKKAMREALEKIKAKLMLMGFISLLLAVGQTPISKICIPAKAGSIMLPCKPPKGAAAAADDDKSDGRRRLLWYPPYPGYDEPGHHRRFLAGAAPDDNYCSDQGKVSLISSAGVHQLHIFIFVLAVVHIVYSVDTMTLGRLTMRK

SEQ ID NO: 87980 - DNA, 897 bp, Zea mays
  misc_feature: Ceres CLONE 1575180
  misc_feature: Encodes the peptide sequence at SEQ ID NO. 87981
  misc_feature (516)..(516): n is a, c, t, g, unknown, or other
aaagctggagctccccgcggtggcggccgctctagaactagtggatcccccgggctgcaggaattcgtctcacccctagaaaaaaacacagcacacattattcttcctccacccatctcttgagtcgcctggccggccgccgtcttggttcccctctagagctcaacagcagagcagctgtgtagcatagagcgaggtttaaccatcagcgcatggccatggcgatctcctctgctcttccgtgctccctcctcgtggcggccctgatgctcctcgcctccgtcgtccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccacgcacagcacaacatctcgctgcactggcacggcatcctgcagctgctcacgggggtggcggacggtncggcgtacatcacgcaggtgcccgatcagaccggccaaagttacgtgtacaactaccccgtcctggggcacccacgccccccttgggtggaacccccaattctcggggttggggccaccgttttaggggcccctgtttttttgcccaagttggggggcccctaacggtttccggggcgcaaaaagggggggccccgcccttttcggggaagggggggggggggacccggaggggggaataaaagggggttttctttttgggtgggcccaagttttttaacccccccaacttaggggggtggggggcgttataaatgtttttcttaaaaaaagttaaattttgggggggcccgcggaaaaaacataaggggccccccccccg

SEQ ID NO: 87981 - protein, 153 aa, Zea mays
  misc_feature: Ceres CLONE 1575180
  misc_feature (35)..(151): Pfam Name: Cu-oxidase_3 Pfam Description: Multicopper oxidase
  misc_feature: SWISSPROT Homolog: EC 1.10.3.2 Laccase
  misc_feature (100)..(100): Xaa is any aa, unknown, or other
MAISSALPCSLLVAALMLLASVVQVQGITRHYDFNVTMANVTRLCASKSIITVNGQFPGPKIVAREGDRLVIRVTNHAQHNISLHWHGILQLLTGVADGXAYITQVPDQTGQSYVYNYPVLGHPRPPWVEPPILGVGATVLGAPVFLPKLGGP

SEQ ID NO: 87982 - DNA, 941 bp, Zea mays
  misc_feature: Ceres CLONE 1575181
  misc_feature: Encodes the peptide sequence at SEQ ID NO. 87983
  misc_feature (645)..(645): n is a, c, t, g, unknown, or other
  misc_feature (646)..(646): n is a, c, t, g, unknown, or other
  misc_feature (744)..(744): n is a, c, t, g, unknown, or other
  misc_feature (755)..(755): n is a, c, t, g, unknown, or other
  misc_feature (756)..(756): n is a, c, t, g, unknown, or other
  misc_feature (796)..(796): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (906)..(906): n is a, c, t, g, unknown, or other
  misc_feature (925)..(925): n is a, c, t, g, unknown, or other
  misc_feature (926)..(926): n is a, c, t, g, unknown, or other
ctggagctccccgcggtggcggccgctctagaactagtggatcccccgggctgcaggaattcgtctcacccctagaaaaagttttttctccctctgctttccccactcgtccgctcctgcttcccgccgccatcgcccatgacgccggcggcaccggcatccgccgcggacgcgcttgcgcagatcctgcaggacctcctgccttcggttctgctggccgcggcgtcggtcatggcgctccactcgcggtggcgcgcgctccaggcctccctcctcgcgttgcagtcctcgctcgtctccgcgcccgcctccgccccgtcccacccgctcttcgccgacctggtggccgcgcttctcccagccctccgttccctccacgcgctctctgttcggtggcaggaaccttggggtcccccgggggcgggtgggggcttcctaacggaacctttacaatgggggggttgcgtccctcttcggttctcccctggaggagaacaattttttggttgctcctttctttgggggggggtgtctttcctgcgaaaatcacaaagagtgtctatcccacctcgagaatcgtaattggcaaggggggctggcttccggggggggtggggctccccccccagaacaagtccccctctnntctttttccggggagggacccttttgtgccccccccccccctcccaaaatcggggtccccttggggacccttaaagcccttaaaaagggagggggctnccaggggggtnnccttgggcccccaaaaccctggtgggggggaaaaggaaanggacccnnnnnnnacccctttttgatgcgggcccccccaattttccccacccccagggaacttggcggggctgctccgttttgggccttgaccgcccgccccattcgggnccttttccgggaccctggnncgtccccggccttgc

SEQ ID NO: 87983 - protein, 147 aa, Zea mays
  misc_feature: Ceres CLONE 1575181
MTPAAPASAADALAQILQDLLPSVLLAAASVMALHSRWRALQASLLALQSSLVSAPASAPSHPLFADLVAALLPALRSLHALSVRWQEPWGPPGAGGGFLTEPLQWGGCVPLRFSPGGEQFFGCSFLWGGVSFLRKSQRVSIPPRES

SEQ ID NO: 87984 - DNA, 901 bp, Zea mays
  misc_feature: Ceres CLONE 1575182
  misc_feature: Encodes the peptide sequence at SEQ ID NO. 87985
  misc_feature (545)..(545): n is a, c, t, g, unknown, or other
aaagctggagctccccgcggtggcggccgctctagaactagtggatcccccgggctgcaggaattcgtctcacccctagaaaaacctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggccctccgcccatcctcacggcgctcgaggtgctcgacaacgacatccgcctcgtgctcgaggtggcgcagcacttggncgagaacatggtgcgcaccatcgctatggacggcacggaggggctcgtccgcgggcagcgcgtcttcaacactggctccccccataacggggctgttgggcaaggctacccttgggacgattccttaaagttttccggggacccaatttgttgaaaagggtgaattaaacgaaaaaaccatttcttcccttttccaagggggaagcccctggtttttttttgggagggcccctgagaacccaaatatttttggttattggaaaacaagggcggcgggggatttttttttgcccccccccccacaaagagggggggaaaaattggggtctcttttccggggggtgtggagaggaggg

SEQ ID NO: 87985 - protein, 176 aa, Zea mays
  misc_feature: Ceres CLONE 1575182
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (126)..(126): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGPPPILTALEVLDNDIRLVLEVAQHLXENMVRTIAMDGTEGLVRGQRVFNTGSPHNGAVGQGYPWDDSLKFSGDPIC

SEQ ID NO: 87986 - DNA, 901 bp, Zea mays
  misc_feature: Ceres CLONE 1575183
  misc_feature: Encodes the peptide sequence at SEQ ID NO. 87987
  misc_feature (533)..(533): n is a, c, t, g, unknown, or other
aagctggagctccccgcggtggcggccgctctagaactagtggatcccccgggctgcaggaattcgtctcacccctagaaaaagctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttcatcctgatgggcttcatctcgctgctcctcgccgtggggcagacgcccatctccaagatatgcatcccgggcaaggctggcagcatcatgctgccgtgcaagcggccgaaagccgccgcgccgacgacgacgacnagagcgacggccggccggagactcctctggtacccgccgtaccctggatacgatgagcccgggcaccacgccggtttctcggccgggcggttccggacgaaaactacggcagggaccaagcaaagggtccctaattccctgggcggggttccacagctggacatttttaatttttggggtcgggggggttcaaaaggttataaggttccccccaggggcccgggggggtttccaaatgggggaaaggaaaaaatgggaaaacggaaaccaccctcctgggaaaacccggtccccaaaaccccctttcggggttccgggttcccccccaaaaaaatttttttgaaaaaggcccccggggggctcttaag

SEQ ID NO: 87987 - protein, 229 aa, Zea mays
  misc_feature: Ceres CLONE 1575183
  misc_feature (5)..(224): Pfam Name: Mlo Pfam Description: Mlo family
MAGGGGGRDLPSTPTWAVALVCAVIVLVSVAMEHGLHKLGHWFHTRQKKAMREALEKIKAEFILMGFISLLLAVGQTPISKICIPGKAGSIMLPCKRPKAAAPTTTTRATAGRRLLWYPPYPGYDEPGHHAGFSAGRFRTKTTAGTKQRVPNSLGGVPQLDIFNFWGRGGSKGYKVPPRGPGGFPNGGKEKMGKRKPPSWENPVPKTPFRGSGFPPKKIFLKKAPGGLL

SEQ ID NO: 87988 - DNA, 958 bp, Zea mays
  misc_feature: Ceres CLONE 1575186
  misc_feature: Translation starting site: 166
  misc_feature: SWISSPROT Homolog: EC 1.4.1.2 Glutamate dehydrogenase
  misc_feature (398)..(398): n is a, c, t, g, unknown, or other
  misc_feature (958)..(958): n is a, c, t, g, unknown, or other
ctggagctccccgcggtggcggccgctctagaactagtggatcccccgggctgcaggaattcgtctcacccctagaaaaacctctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatccncaggaggttcagtgatgcgtctgtccagagtgatatcaagttgtggcgcccttcaaggtcatttctggggcctgctgagaaaccaatgaatgcttggccagcactaggggtgaggaaaagcaatttgccactgaaagagatttccctctagggtttttttttcaaaatgcgtgaaaattgcttgaaaccttaccttggggtggccccactcaagaaagggtggggggtcaaagtccccgggccttccctcaaggggcctccagagaggggggggccccaaaagaagcctggggggtaaatcctccgccccataaaggggcgggggggggttttctcagagagacccaaaatcgggggcctttttccctcttggggttttcaacaaaaggggccccccctgttcccgggagaaaaaaatcttccccccctttttttattcgggggggggggggcactatttgggggccccccctcttccccccgggggagagaggaaattttgtgggggtgagggcccttcggggggggacacacccttgtgggggaggggaggttcaaan

SEQ ID NO: 87989 - DNA, 848 bp, Zea mays
  misc_feature: Ceres CLONE 1575187
  misc_feature: Encodes the peptide sequence at SEQ ID NO. 87990
  misc_feature (714)..(714): n is a, c, t, g, unknown, or other
  misc_feature (750)..(750): n is a, c, t, g, unknown, or other
  misc_feature (823)..(823): n is a, c, t, g, unknown, or other
  misc_feature (848)..(848): n is a, c, t, g, unknown, or other
ctggagctccccgcggtggcggccgctctagaactagtggatcccccgggctgcaggaattcgtctcacccctagaaaaaaaacacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggctttgcggctgccgcgggcgcgcacgtgctcggcgtctgctatgggatgcagctcctcgtgcagtccctcggaggcgccgttgtgtccggggagcgccaggagtacgggaaaatggacgttgaggtgacggcggcctcctccgcgctctacgggcaggcggagaccgggaagcgccagacggtgtggatgagccatggcgacgaggtggttaggctgccggaagggttcgaggtggttgctcgcagcgtgcagggagccgtcgctgccattgagaacgggnagaatcgcttttatgggctccataccaccccgaggntacacattcagcccaaggaaatggaacactgcgccgctttctctttgaatgttgtgggatcaaagctgatggnaagatgcagatgtgctcgatgaagn

SEQ ID NO: 87990 - protein, 224 aa, Zea mays
  misc_feature: Ceres CLONE 1575187
  misc_feature (22)..(204): Pfam Name: GATase Pfam Description: Glutamine amidotransferase class-I
  misc_feature: SWISSPROT Homolog: EC 6.3.5.2 GMP synthase (glutamine-hydrolyzing)
  misc_feature (182)..(182): Xaa is any aa, unknown, or other
  misc_feature (194)..(194): Xaa is any aa, unknown, or other
  misc_feature (218)..(218): Xaa is any aa, unknown, or other
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENGXNRFYGLHTTPRXHIQPKEMEHCAAFSLNVVGSKLMXRCRCAR

SEQ ID NO: 87991 - DNA, 917 bp, Zea mays
  misc_feature: Ceres CLONE 1575188
  misc_feature: Encodes the peptide sequence at SEQ ID NO. 87992
  misc_feature (498)..(498): n is a, c, t, g, unknown, or other
ctggagctccccgcggtggcggccgctctagaactagtggatcccccgggctgcaggaattcgtctcacccctagaaaaactagaaaaaccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcccgcgcgccggccgcctcttctcccccgccttcgccacctccgtctctggagacttcctccgcccgcacggcgggggcgcctccggcatctccaagatcggagattcacattttgagccacgtgagcgtgttcgatacacaagagatcaacttctcgagctgcgtgagaatgttgatgtgtctgaggaaattttnagaatcaagccagagattgatgtagagcttcatggtgaagaccagagctggggtcgcaatgattcaactgttcaaggaaaagcacaagcttaaaccccagccccgaatcgctttgctgaaaactgaaccccttgattgggggggcaagggttggaccacctgaatcccaattaaggaaaaaaaaatttggggaaaccttaggggagggttaaggaaaccttttggcttttcgcgggtggggggcaaaagacaaccctaaagggggaaaaaaggttaagcctccccctttgttttttaaaaaacccaggggggggcccccccccccggcgctcttttaaaagggaaaaaagcgcccgcggccacccccgaaaaagaagaaatttctctagaaaaaaaaaaaatttttataaacacgggga

SEQ ID NO: 87992 - protein, 112 aa, Zea mays
  misc_feature: Ceres CLONE 1575188
  misc_feature (82)..(82): Xaa is any aa, unknown, or other
MQPDQPVISLRPGGGGGPRAGRLFSPAFATSVSGDFLRPHGGGASGISKIGDSHFEPRERVRYTRDQLLELRENVDVSEEIXRIKPEIDVELHGEDQSWGRNDSTVQGKAQA

SEQ ID NO: 87993 - DNA, 891 bp, Zea mays
  misc_feature: Ceres CLONE 1575189
  misc_feature: Encodes the peptide sequence at SEQ ID NO. 87994
  misc_feature (398)..(398): n is a, c, t, g, unknown, or other
ctggagctccccgcggtggcggccgctctagaactagtggatcccccgggctgcaggaattcgtctcacccctagaaaaaagcctccaacccattcttcggcggttcggcccggcctgcaccctgcagccaccaagcaaacccagtgctctgctttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctaccccccncgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcggggacagaatcctcacccagaccgtcacaccgtggaatttctcgcccgccccttcatggcgcctccaacaaaaccgttgtggaaccccaattcggttttctttcccaggggccccctcccgggcaaggtgtcattttgcccggttccaaaccccttttggaaccgggggattttccccctggcccccttttgaaagggggtttcccctatttttccggaaaaaaacctatttcccttttttggagaggggggggaatccccccttgggagagggggtaaatttctcttcccaaaaaaacggctccccaaatttttcctcttctcccc

SEQ ID NO: 87994 - protein, 233 aa, Zea mays
  misc_feature: Ceres CLONE 1575189
  misc_feature: SWISSPROT Homolog: EC 1.8.1.9 Thioredoxin-disulfide reductase
MSLCSKLFALLRKSRALATSTAAAAAATTSATASANGMEEAVAAAGPLRTRVCIIGSGPAAHTAAVYPPRAELKPVLFEGWLANDIAAGGQLTTTTDVENFPGFPDGILGADLMDRCRAQSLRFGDRILTQTVTPWNFSPAPSWRLQQNRCGTPIRFSFPGAPSRARCHFARFQTPFGTGGFSPWPPFERGFPLFFRKKTYFPFLERGGNPPLGEGVNFSSQKNGSPNFSSSP

SEQ ID NO: 87995 - DNA, 1029 bp, Zea mays
  misc_feature: Ceres CLONE 1575192
  misc_feature: Encodes the peptide sequence at SEQ ID NO. 87996
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
aaagcgagaatatgtggaaaatccttagcgggagcttcgcccccaaacccccgatctatcccccccccnnnnnngcaaagctggactccccgcggtggcggccgctctagaactagtggatcccccgggctgcaggaattcgtctcacccctagaaaaaatccactctctcactctctctaatcacaatttcgacactgatcggtactctctagtgtccgactcgtcacagttttagcgagagagacagatagctagcgagggagaggaggatgggttccacttccacgggaccggtgagcgggttcgcggcgccggagcgggacatcgacgatctgccgcggaacgacgccaactacacggcgctcactccgctctggttcctcgagcgcgcggcgctggcgcatccgggcagggcctccgtcgtgcacgggcacgtgcgctacacctgggctgacaccaatcgccgatgtcgccgcctcgcatccgccctcgcgcgcctatccgtcggccacggaagcacggttgctgtgatagctcctaatgtcccggctgtctatgaagctcacttctgcgtcccaatgtcaggagctgttgtgaactgcgtcaatattcggctaaacgccgagacaatagccattcctccttgaacactcgggggaagaagttgctgatggtgggaccaaggaattctggcaccctaggccgaaagaatcccctgaaaaatatttggccaaagaagaaagtacatttggccttttcaatgacgggccttcccaattcttttgaatcggtcagtcgggcgaaaccccaaccttgttggatccgcaagattttctaatcagccatggcttcttgggcgaaaagggcaacccccagagaactattgaaaagaaagttttctttaaaaaaacccggtgttaactctcggagagttttatccttgtgaaaaagcccaccgttaaagggactccaaggggtggcacatatacaatctcccccccatagagggcttcaccttttttcatgg

SEQ ID NO: 87996 - protein, 125 aa, Zea mays
  misc_feature: Ceres CLONE 1575192
MGSTSTGPVSGFAAPERDIDDLPRNDANYTALTPLWFLERAALAHPGRASVVHGHVRYTWADTNRRCRRLASALARLSVGHGSTVAVIAPNVPAVYEAHFCVPMSGAVVNCVNIRLNAETIAIPP

SEQ ID NO: 87997 - DNA, 867 bp, Zea mays
  misc_feature: Ceres CLONE 1575193
  misc_feature (494)..(494): n is a, c, t, g, unknown, or other
caaagctggagctccccgcggtggcggccgctctagaactagtggatcccccgggctgcaggaattcgtctcacccctagaaaaacttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcggggnacccgcgggggcggttcgccgcccccgacgtcgcgagaagtccattgaaccttatcatttagaggaaggagaagtcgtaacaaggtttccgtaggtgaacctgcggaaggatcattgaacccagaaacatagaaggcgtgtacaccaagaagaagccggccaaccaaccgactcccccgaccctcctgatcgatcgagggccccttgttctagccagttgtccccttccctctcgccggcgttgctcctgcttgctccaatggccgctgcctctgccgccgcccccacgaagacggcgaacatccccgcgacgatgcgggccgtgcagtacgactcctgcggcgggggcgccgctggactcaagcatgtggaa

SEQ ID NO: 87998 - DNA, 924 bp, Zea mays
  misc_feature: Ceres CLONE 1575196
  misc_feature: Encodes the peptide sequence at SEQ ID NO. 87999
tccccgcggtggcggccgctctagaactagtggatcccccgggctgcaggaattcgtctcacccctagaaaaaatccctatgatcgccgctgcgtccatcacctcttcttgcgacgtccggagatatggcgtgccaccatgaaggatactctcgcatggaccccaagagggagctcatgtgtgcacttgagtcttcctgggatgagaggagcatcgctaaggatctggagaaggatgctacgttccctctggccctgatctggcaacaaatggactgaggcagggataaagtgagcttccagcagacctgcgcgtacaggaagcaggtccttcagaggagtgccatgctctcggcggttggcaaaagctacatgtggaccgcaggagagataccccccccctctacttctccatagaccgtggcaacgccactgttgctgactgggagatgagcaagtcgtttgacacctacaacaacttaattgggccacagtggggccaaaaacccgattatagaaatatgcatggctaagacgtgaccacaagtttcgggaggctaaagtgcatcagagttgaggcagagcctgtactatattggaccagactcgagcccggctgctgacaatagcaattcgaatggctgtttattaatggatagccaaagtctttcgcattataaacagaactcatcgccgggctacacgcggggccatagacttggctagtaagcaaacctgggacctcaatcggtattggcgggttgaaataatgccaacaatttattctcccgctcctttggagcatttacgcaagcggaccttccattggagatggcagaccattcgaccttcataatgtgaacaatggaaacctttcccaaggtatgggataagagggactaatgtgagggagactcttaacccc

SEQ ID NO: 87999 - protein, 50 aa, Zea mays
  misc_feature: Ceres CLONE 1575196
  misc_feature: SWISSPROT Homolog: EC 2.1.1.14 5-methyltetrahydropteroyltriglutamate--homocysteine S-methyltransferase
MACHHEGYSRMDPKRELMCALESSWDERSIAKDLEKDATFPLALIWQQMD

SEQ ID NO: 88000 - DNA, 863 bp, Zea mays
  misc_feature: Ceres CLONE 1575199
  misc_feature: Translation starting site: 309
  misc_feature: SWISSPROT Homolog: EC 2.7.11.1 Non-specific serine/threonine protein kinase
  misc_feature: SWISSPROT Homolog: EC 2.7.11.17 Calcium/calmodulin-dependent protein kinase
  misc_feature (650)..(650): n is a, c, t, g, unknown, or other
aaagctggagctcaccgcggtggcggccgctctagaactagtggatcccccgggctgcaggaattcgtctcacccctagaaaaatggcttcctctcttcccctcctcccttggccccgtctcgtctcctccccctcaccttcctctccaccttcctccctcccacccctccgcgcctcgccccaccgcgccaaccaaccaacacggcgtcccagcctgcctatataccgctccccccgcgcccccacacgcgcaaatccatatgctcagctcccgcctcctcccatccccggaccccggaccccggccatgggcgcttgcttctcctccgcctctgccgcccccgccggcgccgccgtcgacgagcgccgcccgtccaaggagggcgacggcaagaagaggcgccgcgccgccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgttgccgtcaagcgcatcgacaaggccaagatgacccgccctgttgctgtggaggatgtgaaaagagaagtgaagatttctaagcacttnaaggacatcagaatattgttcactttctacatgcatttgaggatgaatcatacgtgtacattgtgatggagctatgtgagggcggtgaaactatagatcggaatttggcaaaaagaatagctgctatagtgagaaagatgctgcaatggtagttccgccaatgcctcaagtagctgctgaatgccatctgccggggttagttcaccgaaaata

SEQ ID NO: 88001 - DNA, 876 bp, Zea mays
  misc_feature: Ceres CLONE 1575200
  misc_feature: Encodes the peptide sequence at SEQ ID NO. 88002
tggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaggcttaccttggcagcacgatcaagaatgctgttgtcacggtccctgcctacttcaacgactcacagaggcaggccacgaaggatgctggggtgattgctgggcttcaagtgctgcgtatcatcaatgagccaacggctgctgctattgcctatggtcttgaccaagaaggaaaccagcgtcggtgagaaaaatgtcttcatctttgaccctgggagtggggaccttcgaatgtcctccttccttaccatttgaaggaagggtttttttgaggtcag

SEQ ID NO: 88002 - protein, 197 aa, Zea mays
  misc_feature: Ceres CLONE 1575200
  misc_feature (9)..(198): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLQVLRIINEPTAAAIAYGLDQEGNQRR

SEQ ID NO: 88003 - DNA, 847 bp, Zea mays
  misc_feature: Ceres CLONE 1575201
  misc_feature: Encodes the peptide sequence at SEQ ID NO. 88004
  misc_feature (488)..(488): n is a, c, t, g, unknown, or other
  misc_feature (489)..(489): n is a, c, t, g, unknown, or other
  misc_feature (511)..(511): n is a, c, t, g, unknown, or other
ctggagctccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaagacnnagctgagcgcgcgggcatggcngagcagatcaagcgggagatcgccgtcatgaagaatgtgtcccacccccacatcgtggagctgcaccaaggtgatggccacccggctccaaaaattaacttgcgctctaaactcgtcccccggcggggagattttttttccccatttccgcgcccccgggggggggtcccggaaggacattggccccctttttaattttccgggagattcttttcccccggggttaaatttttgccaccgggccccgggggggtgttccccccagaaacctgaaaaattctgaaaactggttcctccctccaaggggggggggacccctcaaaaaggggggggaat

SEQ ID NO: 88004 - protein, 123 aa, Zea mays
  misc_feature: Ceres CLONE 1575201
  misc_feature: SWISSPROT Homolog: EC 2.7.11.1 Non-specific serine/threonine protein kinase
  misc_feature (52)..(52): Xaa is any aa, unknown, or other
MEDAMAADGKSVLQGRYELGRVLGHGNFGRVHAARDLRTGRSVAVKVVAKDXAERAGMAEQIKREIAVMKNVSHPHIVELHQGDGHPAPKINLRSKLVPRRGDFFSPFPRPRGGVPEGHWPPF

SEQ ID NO: 88005 - DNA, 861 bp, Zea mays
  misc_feature: Ceres CLONE 1575202
  misc_feature: SWISSPROT Homolog: EC 2.7.11.1 Non-specific serine/threonine protein kinase
tccccgcggtggcggccgctctagaactagtggatcccccgggctgcaggaattcgtctcacccctagaaaaaacgcacacagtaatcctatcccagtcccagcagcagcaacttgcgctttggtccggcaaatgggctgtgaattctgcgccgcctgaccgtcgcccgcccccgccccccacaaacaaggggtggaagtgtttggtttctgtgtcttcaagtgtatctaccctgctaatatcttgtgtggcagcgttgacctggttgattaagccatttttggcatttcgcaggctctgtttacacgagtctggtcctccgctattcccacataaatgattaggaagagaagagtccagcctgaccaccgtcgctttctttttcccaaagctttttagaccgtattccaatgacagcaccggagatctgcattctaggtttaacacatgttgtgctaccgacaattactactagccaaagaccaaagtagaatcactggcaatgaaaaacaccaagttttggatccatcaaaatactacaagctcacaaaaacaataacttccttctctctctctcaagaattgagtattttttgtccgtgctccagtgagcttactgcttttttgctgccagatcaaaagggaaatatcaatcatgaagatcgtaagacatcccaacatagtcaggcttaatgaggtgttggcacggaagacgaactatacataatcttggaacttgtcaatggaggcggactgtttgtataatagcccgatatgggaagctacgtgaggatgaagcccggaagtttttctgcagcttattgatgcccttgattattgccgccgcaaacgagtttattt

SEQ ID NO: 88006 - DNA, 861 bp, Zea mays
  misc_feature: Ceres CLONE 1575203
  misc_feature: Encodes the peptide sequence at SEQ ID NO. 88007
ctccccgcggtggcggccgctctagaactagtggatcccccgggctgcaggaattcgtctcacccctagaaaaaaacagcgccggccgggccgttgcgtccgtccatcctcatccccatccgccacccaccccgcgcccctccttctcactccagtgctggctgccggccagctccgcccccggggtccttgagctggaggtggcggtggatgaccacctctcggagttttctgaggcgaggatccgagggcgttgcattaaggccgccgatggtgagccgcgggcggagcggtctcacgcgcggcggggtcgttcgatgacgcaggaatcgcgctctgggagggtgggaatacctcgcgctcgcgctcaaggagctcgattaatttactgcctgaggctgagggagggcgcgcctgtgagctgaaccgttcccgctgcactgactcctgagctcgggaaatggttgggagcgtgcacatcaatggatcggtccacggcggcaatggcacggccacggaagagcggctggacaagctgcgccggctgctctgcaaaaccgagggggaccttctcaagatcatcagcgtccgcgcccgcgcgaggggcagcgtcttccccgcgctcctacaagaagcgtacgggcatttccggggaaatgtgcaaaataaagatgatggcgtccccccgggccggacggtggacccttccccgccggaagaacctgtttgaggggatgaaactccccgggaggaagagtttctgggggcccctatcccgccgcgtgggggtgacctcaaagtaacttcccaaggggcgggcctccccagaaacacccaggctgtatttctccacacaaaaaa

SEQ ID NO: 88007 - protein, 89 aa, Zea mays
  misc_feature: Ceres CLONE 1575203
MVGSVHINGSVHGGNGTATEERLDKLRRLLCKTEGDLLKIISVRARARGSVFPALLQEAYGHFRGNVQNKDDGVPPGRTVDPSPPEEPV

SEQ ID NO: 88008 - DNA, 825 bp, Zea mays
  misc_feature: Ceres CLONE 1575205
  misc_feature: Encodes the peptide sequence at SEQ ID NO. 88009
ctccccgcggtggcggccgctctagaactagtggatcccccgggctgcaggaattcgtctcacccctagaaaaatcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcaggggcttcgacgcgcgcacccaccgcgcgctcgactcgctccaccggcggggaggcctcatcgacgcctccgtctcgcgcgcgctcgacaccttcatttcatttcggcttcggcttcggcggcggcggcggtttcttcaaaggccccggccaccttcgactcggatttcgaggggctcccccaaaagcctggccccccctttgcccgccggaaggaactccgcccccggttccttggggctttctgggggggcccccccccccagggaaggcgggaaaccctctttggggggcaaaaaaataccccccgggggcctctaaaactcttgtgtgttgggaatcccgggcccaaaa

SEQ ID NO: 88009 - protein, 185 aa, Zea mays
  misc_feature: Ceres CLONE 1575205
MASPAAAAAAAPPPAAKEKEKDAEEAPVTGDMVSAGFAELERQQQLLATCTRLYQQLSDHFGSLERGLAARSDALRVRRRGFDARTHRALDSLHRRGGLIDASVSRALDTFISFRLRLRRRRRFLQRPRPPSTRISRGSPKSLAPPLPAGRNSAPGSLGLSGGAPPPREGGKPSLGGKKIPPGGL

SEQ ID NO: 88010 - DNA, 858 bp, Zea mays
  misc_feature: Ceres CLONE 1575209
  misc_feature (786)..(786): n is a, c, t, g, unknown, or other
ctggagctccccgcggtggcggccgctctagaactagtggatcccccgggctgcaggaattcgtctcacccctagaaaaaacggttttttctttctcattctccctcctcttcctgctccccttggcactgcacgtctgcacatgtgaatacgtttttgcctccttccggcctcccttatttccacgatcgatacccacgggtcgaaaaagaactgagtttcaccacccgtggcacttcgtccaaggcagcggctccagttaccggcaaagcgctacgcggctgtgactgacgcctacgacggccggcgacgtggcactgaccatatggagaagatttcctgagccaagggtgagaagagtctccgcactaggcgaatcgaggtgctccgagccacgacccggtgccctctgtgccgggtctatacgatgcttacacccctcgctcgtttggctagtgcggcttctacggataataataaccttcagcttcacgacaacgtggcggtgcccgcattggtctctgatcagagcgagtcaccccgctcggcaggttctccaaacgcgtctggcacgtggatttgtcccgtctcctcgtcgatacgattgccgctggctgcgactcgaactcgcctggatcactcacacatattgctatcaggcacttctgactctacagagggtgcatcttctactgcgagctattcctatatctgctcaccttctcgtctctagtaccgatccagtctctcgacagtgtgcacgaacactgcgccatgtagatccgnatcagccagatgctgcagactcgttgtgcaaatgtgccctgatgccgccatttgcactttgactgactactc

SEQ ID NO: 88011 - DNA, 779 bp, Zea mays
  misc_feature: Ceres CLONE 1575211
  misc_feature: Encodes the peptide sequence at SEQ ID NO. 88012
  misc_feature (631)..(631): n is a, c, t, g, unknown, or other
  misc_feature (731)..(731): n is a, c, t, g, unknown, or other
aaagctggagctccccgcggtggcggccgctctagaactagtggatcccccgggctgcaggaattcgtctcacccctagaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcaccgcggcggcgcctgggtcggacgccaccgcgctccacgcagcgctccggcgcgcgctcgactcgtacggacccaccgaagtgtggggcgagctactgcacggtccgtgcctctgtcccgtctagtcccccttcgccccgtccactcggatgctcctactacgggttgctttcccccggggggttttccagttttccccaagggcggggtggggggcccttggaaaaccccccccagacccccccaaaggggaggggggtttttttaacaaaaagggggggcgcctttgttcccccaaagggctcgtgttttaaaaaaaaattttttttttgggggggagggtttttaaaaagaaaaacccccccccccccccggggtgtttttttttttagaaaaaatcttcttctcnaagagagagttttttttcttctctccgcgggaggaaacccccccccggggggggggtttcttgttttttgaaaaaaaaaaggagggttgttttttttttntttaaaaaaaaaaagagtggggggggggtatctgcgccacccctcacc

SEQ ID NO: 88012 - protein, 58 aa, Zea mays
  misc_feature: Ceres CLONE 1575211
MATTLHKPLGAITVDDLTAAAPGSDATALHAALRRALDSYGPTEVWGELLHGPCLCPV

SEQ ID NO: 88013 - DNA, 1041 bp, Zea mays
  misc_feature: Ceres CLONE 1575212
  misc_feature: Encodes the peptide sequence at SEQ ID NO. 88014
  misc_feature (705)..(705): n is a, c, t, g, unknown, or other
  misc_feature (910)..(910): n is a, c, t, g, unknown, or other
  misc_feature (918)..(918): n is a, c, t, g, unknown, or other
ctccccgcggtggcggccgctctagaactagtggatcccccgggctgcaggaattcgtctcacccctagaaaaaaaaaaagtcggacataaaaaccagaaaaggggcgtcgaacctagggtttcgtctgtctcccgacgccgccgctaggctttgcgcctttgcctgcatcactcgctcattcggagcccctctcttcgccggcgtcgtaagaagagatggcagagcgtttgacccgtatcgccatagttagcgaggacaagtgcaagcccaagaagtgccgccaggagtgcaagaagagctgccccgtcgtcaagactgggaagctttgcattgaagtgacttcggcgtcgaaactcgctttcatttctgaggaactgtgcatcggtcccccccccctgtgcaaagaaatgcccatttgatgcgggggaaatcatcaaccttccaaaagaattggaaaaagggataccactcccccggttatggggccttaatacctttcaaagctgccacagggttgccctggtccccgaagacctggggcaagggttttgggggccttgtatttggaaccaaagggggaaatttggaaaaagtccaaccggctccttttaaaaggtgtttggcctggggccaagacttaaaaaacccctaaagtttgggggggccgcctttataaaaaaacccagcccgtggattgtggggnggggaaaaaattctttataacaaagctgttccggggagtgggtcttggaagtctctgggaaaaatgtatttttccacccccggtgttttgtggaagaataaacttttggggggggaattttttcaaaccctcccggggttttgtgggcccacactcccccaaaaggggttctctcacagggaaattggtgggacacacgtgcttnttaaccanaaggagccccagcgggtgattagaaacaccccacaccgggtggggtgccctctgacataaaagagcacaccattttctcccacaaagtgtgtgaaactttttttgtggggcgggagttccctg

SEQ ID NO: 88014 - protein, 67 aa, Zea mays
  misc_feature: Ceres CLONE 1575212
  misc_feature (6)..(37): Pfam Name: RLI Pfam Description: Possible metal-binding domain in RNase L inhibitor, RLI
MAERLTRIAIVSEDKCKPKKCRQECKKSCPVVKTGKLCIEVTSASKLAFISEELCIGPPPLCKEMPI

SEQ ID NO: 88015 - DNA, 916 bp, Zea mays
  misc_feature: Ceres CLONE 1575218
  misc_feature: Encodes the peptide sequence at SEQ ID NO. 88016
aaagctggagctccccgcggtggcggccgctctagaactggtggatcccccgggctgcaggaattcgtctcacccctagaaaaaaatcccctccccacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtacgcagatcgagatggattgtggacctgatgacatgcgtgggtacatacatttcttcagatgcggtggtgtgcatgtggagagatgtcaacctgccatggtgtgacggtccgccatgagttgaccgacctcatcttctctccttttgctcagaacgcacacacacccccaaccccgatgtccgatcccctcgtcgatccaagatgcagatcttcatcaagaccctcactggagagactatcaccctcgaggtggagtcttctgacaccattgacaacgtcaaggccaagatccacgacaaagagggcattcccccggaccagcagcggctcatcttcgctggcaagcagctcgaggactggcgcacacttgcgaactacacatccagaaagagagcaccctccaccttgttcttccgcgtcaggggaagcatgcaaatcgtcctcaagaccctcactggaaagactatcacccttcagggtggaggcttcttgacagcattggacaaatttaagggccaagaaccgggaacaaggaggggcattccttcccggacaagcgaggcggcccaattttttcgccggtaagaccgcttcaggggaaaagggggccaaaaactggggcccaaaataaaaaaaattttcctaaagaggagaagggattcccttcccgaccttgt

SEQ ID NO: 88016 - protein, 127 aa, Zea mays
  misc_feature: Ceres CLONE 1575218
  misc_feature (6)..(76): Pfam Name: ubiquitin Pfam Description: Ubiquitin family
MQIFIKTLTGETITLEVESSDTIDNVKAKIHDKEGIPPDQQRLIFAGKQLEDWRTLANYTSRKRAPSTLFFRVRGSMQIVLKTLTGKTITLQGGGFLTALDKFKGQEPGTRRGIPSRTSEAAQFFRR

SEQ ID NO: 88017 - DNA, 859 bp, Zea mays
  misc_feature: Ceres CLONE 1575220
  misc_feature: Encodes the peptide sequence at SEQ ID NO. 88018
aaaactggagctccccgcggtggcggccgctctagaactagtggatcccccgggctgcaggaattcgtctcacccctagaaaaaattagagatagatctactacccgaacagtttacctgagtatagtgccatgtcgacggcaccccacttcgtgctggtgccgctcctggcgcagggccacatgatccccacgatggacctggctcgcctcatagccagccagggcgcgcgtgtcacggtggtgctgacgcccgtgaacgccgcgcgccacagggccgtcctggagcacgacacgcgtgcggggctcgccatcgacttcgccgagctcgcgttcccggggcctgcggtcggcctccccgagggctgcgagagcttcgacatgctggcagacatctccctcttcgccacgttctacgaggcgctgtggatgctccccgagccgctcgaggcgtacctccgctcgctgccccgtctcccggactgccttctctgcgactcgtgcagctcgtggaccgccaccgtcgcgcggcggctcggcgtcctgcggatcgtggtccacttcccctccgcgttctacatcctcgcggcgcacagcctcgcgaagcacggcgcgtacgaccgcgccgccgacgacttcgagccgctcgaggtgccggcggagttccccgtgcgcgccgtggtgaatagagatagcaataggtaaaaacccgctgggtattacttgcccaaacccataaccacgaaaaaacaatacgcccgctaaaaaactcatacccatgacgggtatgaaattttgcccaaacccataatcatgcgaggttcggggtacccacggcgtttcctatacccactaacatc

SEQ ID NO: 88018 - protein, 190 aa, Zea mays
  misc_feature: Ceres CLONE 1575220
  misc_feature: SWISSPROT Homolog: EC 2.4.1.238 Anthocyanin 3'-O-beta-glucosyltransferase
MSTAPHFVLVPLLAQGHMIPTMDLARLIASQGARVTVVLTPVNAARHRAVLEHDTRAGLAIDFAELAFPGPAVGLPEGCESFDMLADISLFATFYEALWMLPEPLEAYLRSLPRLPDCLLCDSCSSWTATVARRLGVLRIVVHFPSAFYILAAHSLAKHGAYDRAADDFEPLEVPAEFPVRAVVNRDSNR

SEQ ID NO: 88019 - DNA, 860 bp, Zea mays
  misc_feature: Ceres CLONE 1575222
  misc_feature: Encodes the peptide sequence at SEQ ID NO. 88020
  misc_feature (779)..(779): n is a, c, t, g, unknown, or other
  misc_feature (780)..(780): n is a, c, t, g, unknown, or other
  misc_feature (823)..(823): n is a, c, t, g, unknown, or other
cagagctggagctccccgcggtggcggccgctctagaactagtggatcccccgggctgcaggaattcgtctcacccctagaaaaaatccgttccatttcttatcccctcctcctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtacgggagcgacgccgacgaggggttccagggggacgaggaggagctcgccattgccaggctcggcctgcccgacgagctcgtcgccacgctcgagaagcgcgggattacgcacctgttccccatacagagggctgtgttgattcccgctcttgagggccgtgacctgattgctagagcaaagaccggaaccggaaagacacttgcctttggtattcccatgatcaaaaaattaatggagcaagacgatggtcggagtacaaggcgaggtcgtactcctcgggttctggttctagcacctaccagagagttagccaaacaagttgagaaggaaataaaggaatcagcacccaagcttggcacggtgtgtgttttatggcggtgtctcatataatgtccagcagaatgcactctcgcgtggtgttnnaatgtttgtgttggcacacctgggcgcataattgatttgaatnaatggtgggagcctcccagtggggagaagttcagtat

SEQ ID NO: 88020 - protein, 202 aa, Zea mays
  misc_feature: Ceres CLONE 1575222
  misc_feature (112)..(202): Pfam Name: DEAD Pfam Description: DEAD/DEAH box helicase
MASLVTLPAIAFSNPATASGAVRLRAAAFRCWALRRRGWAVAAAVASPNSVLSEHAFKRLQLGSDDEDEEGPYGSDADEGFQGDEEELAIARLGLPDELVATLEKRGITHLFPIQRAVLIPALEGRDLIARAKTGTGKTLAFGIPMIKKLMEQDDGRSTRRGRTPRVLVLAPTRELAKQVEKEIKESAPKLGTVCVLWRCLI

SEQ ID NO: 88021 - DNA, 879 bp, Zea mays
  misc_feature: Ceres CLONE 1575223
  misc_feature: Translation starting site: 214
ctggagctccccgcggtggcggccgctctagaatagtggatcccccgggctgcaggaattcgtctcacccctagaaaaattacgtttccaccctttcttttgtggttctcccgcgctctgtgtccctagaggcgacgactgggcgatggtcgccgccttaagccagtgctcatgtctgctacttggcacttcgccggcgaccaccatctaaacatggcgtggtggttttcaagtactgcagtgcttgcgaggccatttttgggtttcttgccagacctgcagagtgctgatatgaaaatacccttcacagagacagtgatcctactcgggcgtttcatcacatacgcttgtctggtctgcagacgcctcccattctatggcattcattgaactactgacactgagcctttctactggatgcctgttattcttgcgtcaaaccgtggtactggtatggaactgggtatcgcatccgattgtaagatctgtgaatggtgatgcaacttcaagtgggatcgctgattattgaagttgacaaccgtgtcagggaggatcgagctctgctgatggagcgcacatcttgcatggtatccatattgcctttagagaagccgtatcgtatgttctctctggactgtatggcagagtgagccaacttggaactgtgaatgctatcatcgttatacttcggctttactatggtggtgagcttgtcatctgctctggatgaactctttccgaaggctatggattgggatctggctctctctcggatctatgctacgtaatatctaggaggatatcatcttgccaggagtatagtctgatcacctatctacagggtgtcgtgggggctggaattagaaggcggcatttctt

SEQ ID NO: 88022 - DNA, 1238 bp, Zea mays
  misc_feature: Ceres CLONE 1575224
  misc_feature (55)..(55): n is a, c, t, g, unknown, or other
  misc_feature (56)..(56): n is a, c, t, g, unknown, or other
  misc_feature (64)..(64): n is a, c, t, g, unknown, or other
  misc_feature (65)..(65): n is a, c, t, g, unknown, or other
  misc_feature (72)..(72): n is a, c, t, g, unknown, or other
  misc_feature (330)..(330): n is a, c, t, g, unknown, or other
  misc_feature (333)..(333): n is a, c, t, g, unknown, or other
  misc_feature (477)..(477): n is a, c, t, g, unknown, or other
atgttattcttaaaaattaaaaactaaaaaccaagcaacacaatcttatataaannaaaaaaannaagatanccaaactggaagctccctcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtctaggacgggtaggttcatcggtctcntcnccgggttttcaggtaaagtcgggtcaggtcaactctgtcgaagaaggaacatcgaagaaaggaaggaggtgggcggcaatggaggatgcgatggcagcccaccggaagtagcgttgctgcaagggcggtacgatttggggcaanacttgcccccacctcaacttagggcgggtgcacgcccgcgcgggacctgcccactgggccgacagctgtcgcggtcaaaggtggtggccccaaggaacagcctgggatccgcggcgggccatggtcgggagcccgaatccatgtccgggaggattcgcccgtcctttgaaaagaatgggtgggtccccaaccccccaagtcatttgttggggaagctcttggcaatagaaatggtggaaaaggggcccatccccgcgggatgtcgcaagagaattcataatccctattcgggggactatttggaagagctctctgatccctcagacgcgggcgtaaggggggcgatacggccctgctctttttttttcctcccatacccttatcctaccagtcggatcgctcgtgtgggagactgcggggtgttcccccgtggtataaggagaactgtgatgtccgcgccgcgccttttgataaaaaagtataatcctggggataagatgtctgaggttcgttctacgatagcgtggtcggaatatttctcgtggagctctacaggaggcgctataagagggggatgtgtattaccaccccccggggagaagccttttgtaaagaggtcggcgcgaaaaacctcggtgggtgcctcttcgccgagaaagggtaggtgggtggacactctccacaaggaggcgggctcgaatatttttagggggatgcaagcgctgttgtttgttcacccgtgggcccactgacgcggtctt

SEQ ID NO: 88023 - DNA, 896 bp, Zea mays
  misc_feature: Ceres CLONE 1575225
  misc_feature: Encodes the peptide sequence at SEQ ID NO. 88024
  misc_feature (790)..(790): n is a, c, t, g, unknown, or other
  misc_feature (797)..(797): n is a, c, t, g, unknown, or other
  misc_feature (798)..(798): n is a, c, t, g, unknown, or other
ctggagctccccgcggtggcggccgctctagaactagtggatcccccgggctgcaggaattcgtctcacccctagaaaaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctctacctgccgccgccgcaccccgtatgatatgtgatacacagctgggatggtatactgatattttggggttatttcaaaaaaaaaaaaataccggaaatgtgtcttttttgaatcaacatgaaaggtttggatgggtatcagggntcaattnnatgtggtactggatgtgtatttagaaggcaggcatttatatggttatgatgcccccaaaacaaagaagcctacatcaaggactttgcaactgctgccc

SEQ ID NO: 88024 - protein, 140 aa, Zea mays; identical to SEQ ID NO: 8517
  misc_feature: Ceres CLONE 1575225
  misc_feature (67)..(140): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)

SEQ ID NO: 88025 - DNA, 914 bp, Zea mays
  misc_feature: Ceres CLONE 1575227
  misc_feature: Encodes the peptide sequence at SEQ ID NO. 88026
tggagctccccgcggtggcggccgctctagaactagtggatcccccgggctgcaggaattcgtctcacccctagaaaaaacactcccagtcccagtctcccaccgtcccacgaaacacactcaactctgccccgaagcggagaaccgccagccagacatgaagagaaccagagcgcagcagcccaaggtcgtggagccgcaggacctcgccgccaacctaaagccgcagcgccgggacaaacagccgaggcagcccaagtcaggcgccaaagcgaagcccgcggcgggcccgcgcgtcgcggcggccacaacactcgccgccgccgccgccgcagcagcagcagcagcaaatgccgcctctgccgcgtcgtcgcccgggccggaaaaaggtcccaccatgccagacgtgtgtgttcggcggggacaaagacggggacgcggaccctgacaccagcgccctggactgggacctccacgcccggctgaaccccggcgcctggtggaacgtgcggcgtggacaagaaaaaaacctccggctggggtccccctccggggagggaggattttcggtgcgccccggggggggccgcccccaaggagggcccccctccaccccccgacattggggggtgtgggggggaaaagaacctttcgtggagaaaaaacaaccccaagcccgggggggggaggcgccaatttagatcgggggtagtctttgtccctgtccccagggggttggagagggggggagccttctgtaaccataaatcccgtgaaatccttggcgccaggaaaacgcgtgagtctgaggtcgtcctctgctcgaaaaccataaacgacctcgccgtcgggataaggggggggaatttctattccaccctctctgttgtatatactctaaccgcgcccgcgct

SEQ ID NO: 88026 - protein, 96 aa, Zea mays
  misc_feature: Ceres CLONE 1575227
MKRTRAQQPKVVEPQDLAANLKPQRRDKQPRQPKSGAKAKPAAGPRVAAATTLAAAAAAAAAAANAASAASSPGPEKGPTMPDVCVRRGQRRGRGP

SEQ ID NO: 88027 - DNA, 883 bp, Zea mays
  misc_feature: Ceres CLONE 1575229
  misc_feature: Translation starting site: 230
  misc_feature: SWISSPROT Homolog: EC 5.5.1.4 Inositol-3-phosphate synthase
  misc_feature (401)..(401): n is a, c, t, g, unknown, or other
  misc_feature (506)..(506): n is a, c, t, g, unknown, or other
  misc_feature (597)..(597): n is a, c, t, g, unknown, or other
  misc_feature (662)..(662): n is a, c, t, g, unknown, or other
aaagctggagctccccgcggtggcggccgctctagaactagtggatcccccgggctgcaggaattcgtctcacccctagaaaaaaccacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccncggtccccaagctcggggtcatgcttgtggggtggggagggcacaacgggtccacgctgacggctggggtcattgccacagggaggggatctcatgggcgactangggacaggtgcagcagagccactactacggctccctcacccaggctttccacatcagagtaggcagctaccacgggaagggagataatgcngccgttcagaagcttctacccatgttgaacccaaacgacttttggtttgggggcttggaattcancaccatgaaccttgcaaatggcattgcccgggcccaagggggttggaaatttgacctggcaaaacagtttggggccctaacgggagtcccggggggcccctttcccggggtttttggaaccggaattttttcgcccataaacaggggtttttgggggccaaaaagtgtttcagggggccccaaaaaaaaaaaaggggggggaccaatttctctaaaaattt

SEQ ID NO: 88028 - DNA, 853 bp, Zea mays
  misc_feature: Ceres CLONE 1575230
  misc_feature: Translation starting site: 194
  misc_feature: SWISSPROT Homolog: EC 1.4.1.2 Glutamate dehydrogenase
  misc_feature (814)..(814): n is a, c, t, g, unknown, or other
ctggagctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctactttcacgactcacagaggcaggccacgaaggatgctggggtgattgctggcctcaatgtgctgcgtatcatcaatgagccaaccgctgctgctattgcctatggtcttgacaagaaggcaaccagcgtcggtgaagagaatgtcctcatctttgaccttggnagtgggtaccttcgatgtctccctccctactattgagga

SEQ ID NO: 88029 - DNA, 896 bp, Zea mays
  misc_feature: Ceres CLONE 1575231
  misc_feature: Translation starting site: 149
aaagctggagctcaccgcggtggcggccgctctagaactagtggatcccccgggctgcaggaattcgtctcacccctagaaaaagccttgcagcagctcgatcgcttcctcctgtccgcctggaagtggaaggccacaaaccatagccatggtgtctctctgcgcatccaccaccaccatgtatgccttcctagtcatactcttcatccactctggccactctccgaccgctgcattctacctcccgggcagttatcctcagcggtaccggcccggcgacacctttgccgcaaaggtgaactccctgacctcgccgtcctccaagctcccctacccctactactcccttcccttctgcgccccgcaacagggcgtccggcacgccgccgagagccttggcgagctcctcctcggcgaccgcatcgagacgtcgccataccgcttttccatgctcaacagcaccgcatcgcccttgttcctctgccacaccgaccccctgtcccccggcaccgccgagctcatcaagtcccgcatcgatgacgcctatcaggtgaacatcctcctcgacaccctccctgtgatgcgctacgtgaagaaccctgtcgcgcccgacgtgctcctccggtccaccggcttcccggtcggcgttcgcgccgacgacggcgagtactacgtgtacaaccacataaagctcaccgtgctggtgaacaagcagaacaccaccaccaggggtggagaccttgatggcgaccgccgaacgggccgatctgatcagcttcaccggtggcaaggaaggctgcggctacacggtcgtcgggttcgaagtcgtcccgtgcagcgtgaagtacgacgcggcggctgtcaagaaacagaccatgtacgacgagatcacgtcg

SEQ ID NO: 88030 - DNA, 797 bp, Zea mays
  misc_feature: Ceres CLONE 1575232
  misc_feature: Translation starting site: 154
  misc_feature (406)..(406): n is a, c, t, g, unknown, or other
  misc_feature (593)..(593): n is a, c, t, g, unknown, or other
  misc_feature (599)..(599): n is a, c, t, g, unknown, or other
aaaagctggagctcaccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcnggcatgaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaagcacaacgatgacgagncagtancgtggtgggagtcccccagcggggcggggtcgtttcactggtttactccgtgacaccgtccagggggagccagccttgggcaggggggcacctaaaaaatccccccccttgtttccccccaagggaaaaattcagccggggagataccccttggaggggagggccgccccctcccaggaaattgggggtcaaaaaaaa

SEQ ID NO: 88031 - DNA, 925 bp, Zea mays
  misc_feature: Ceres CLONE 1575235
  misc_feature: Encodes the peptide sequence at SEQ ID NO. 88032
aaagctggagctccccgcggtggcggccgctctagaactagtggatcccccgggctgcaggaattcgtctcacccctagaaaaaactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtctcccccaaccccggcggcgcgtccatggagatccaccaggcactcacccgctcccccgtcatcgccaaccacctctttcggccacgagcaagggggagggcctttgccgccttccgggtacgcgcggctcctcggggccgcgttcgggcgtctgcattcggcaacctcccggcccccggggcccaccaaacctaggtttcccgggcttccccgaaagcgcctgattcgaattccgttccccatggggtcccccaatcccgggaaaaagggtgccccccgaccccaagaaattgggcaaccgaaaccccttctccggaaaacacccctactttcttgaaggttaacccggctccccttcccccagaagaacaaaaatccgtggggctctccgaagttaaaaaaacaattccccccggtttttgggggaagagaggttttctttccccccccgccccctcgggggccaaaacagagggccggggtgttttgtttaaaaacccccaagagggaccttcccccgcccgaagggg

SEQ ID NO: 88032 - protein, 147 aa, Zea mays
  misc_feature: Ceres CLONE 1575235
  misc_feature: SWISSPROT Homolog: EC 2.2.1.6 Acetolactate synthase
MATAAAASTALTGATTAAPKARRRAHLLATRRALAAPIRCSAASPAMPMAPPATPLRPWGPTEPRKGADILVESLERCGVRDVSPNPGGASMEIHQALTRSPVIANHLFRPRARGRAFAAFRVRAAPRGRVRASAFGNLPAPGAHQT

SEQ ID NO: 88033 - DNA, 891 bp, Zea mays
  misc_feature: Ceres CLONE 1575237
  misc_feature: Encodes the peptide sequence at SEQ ID NO. 88034
  misc_feature (787)..(787): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
ctccccgcggtggcggccgctctagaactagtggatcccccgggctgcaggaattcgtctcacccctagaaaaagcgtttgtttctcttctcgacggggacgaccgccagagccgccgccttacgtccagctgccacagtacttcatcgggccctttgccggtgcaggcggcgcagcacccaccgcaccaggattctgattgctcttcattaggctataaatggcaggaaggcaccgggcaccccgacaataccatgatgaacctcgaggataccgtgatggtccaccacctccacttccacgaccaagacctctctcaccgcgtcgcatggcagaggaactgtctaggcgccgtgctgagatgcgtagaatccatgaggacaatcagcgtctggcggatgaaattgttagtctcaagcaaaccatgccgcgtttgcaagaagacctccgaatctcaagccaggctgtgccaaagctccgggcagagaaagagctcgagtcgagggagctgactcagaggaacctgaagctggaagctgagctgcgtgccttagaacccctcaggcaagacgctctgcatctgcgatccgaagcaagtaaattgcagtctctgaggcaagagttggctgcgaaggtgcaaggcctatcaaaagagcttgaacttcagaagtctgaaagccagaaaatgactgctttggtagctgaacgtgatgcgctgtgtcaagaactgctccaggctagggcgaaaccttgagttgagaaagaagcgaagccagagctgactgcncagcgagaagttggtgtcgggacagtatcaataccatccctgatgcctcacgagtagataggagaannnnnnnnnnnnnnnnnnnnnnnnnnnnnnnnnnnnnn

SEQ ID NO: 88034 - protein, 177 aa, Zea mays
  misc_feature: Ceres CLONE 1575237
MAGRHRAPRQYHDEPRGYRDGPPPPLPRPRPLSPRRMAEELSRRRAEMRRIHEDNQRLADEIVSLKQTMPRLQEDLRISSQAVPKLRAEKELESRELTQRNLKLEAELRALEPLRQDALHLRSEASKLQSLRQELAAKVQGLSKELELQKSESQKMTALVAERDALCQELLQARAKP

SEQ ID NO: 88035 - DNA, 1204 bp, Zea mays
  misc_feature: Ceres CLONE 1575239
  misc_feature: Encodes the peptide sequence at SEQ ID NO. 88036
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (348)..(348): n is a, c, t, g, unknown, or other
  misc_feature (391)..(391): n is a, c, t, g, unknown, or other
  misc_feature (405)..(405): n is a, c, t, g, unknown, or other
  misc_feature (424)..(424): n is a, c, t, g, unknown, or other
  misc_feature (426)..(426): n is a, c, t, g, unknown, or other
  misc_feature (428)..(428): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (437)..(437): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (504)..(504): n is a, c, t, g, unknown, or other
  misc_feature (510)..(510): n is a, c, t, g, unknown, or other
  misc_feature (529)..(529): n is a, c, t, g, unknown, or other
  misc_feature (530)..(530): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (546)..(546): n is a, c, t, g, unknown, or other
  misc_feature (554)..(554): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (577)..(577): n is a, c, t, g, unknown, or other
  misc_feature (608)..(608): n is a, c, t, g, unknown, or other
  misc_feature (609)..(609): n is a, c, t, g, unknown, or other
  misc_feature (611)..(611): n is a, c, t, g, unknown, or other
  misc_feature (618)..(618): n is a, c, t, g, unknown, or other
  misc_feature (619)..(619): n is a, c, t, g, unknown, or other
  misc_feature (786)..(786): n is a, c, t, g, unknown, or other
  misc_feature (787)..(787): n is a, c, t, g, unknown, or other
  misc_feature (800)..(800): n is a, c, t, g, unknown, or other
  misc_feature (804)..(804): n is a, c, t, g, unknown, or other
  misc_feature (843)..(843): n is a, c, t, g, unknown, or other
  misc_feature (877)..(877): n is a, c, t, g, unknown, or other
  misc_feature (978)..(978): n is a, c, t, g, unknown, or other
  misc_feature (984)..(984): n is a, c, t, g, unknown, or other
  misc_feature (990)..(990): n is a, c, t, g, unknown, or other
  misc_feature (1039)..(1039): n is a, c, t, g, unknown, or other
  misc_feature (1084)..(1084): n is a, c, t, g, unknown, or other
  misc_feature (1094)..(1094): n is a, c, t, g, unknown, or other
  misc_feature (1179)..(1179): n is a, c, t, g, unknown, or other
  misc_feature (1199)..(1199): n is a, c, t, g, unknown, or other
tggggtgagaaaagttgtttatttctttatctggaggtttctagaaaacgatgagagatgnncctcncnnnnnttcaaaactggaactccccacggtggcggccgctctagaactagtggatcccccgggctgcaggaattcgtctcacccctagaaaaagcttccctgtctcgccgccacctcctcctcctctgcgctccccgttccccaggtcgcgcgcacccgctcccgcaccggagaacccaccgcacgccggcctcgtcccgagatggcggcggcgctgcgcttccctggggtcgcgagggagtctctgtctctggacgcgcccgtcgccgcctccaagctcnggagggagcggcgcccggtccccgcgagcgcgaatctggggtngtaatgttggaggnggaggaagggggtggaggngngntgnnnnacngggnnnaannnnanngnntgttttttggacggtaggtaggttgttgtgcccctcccccnnncnnnanggaaanacccaggggggggataaannggtggnnnatgaaaanttcggggnggttgggtgggtttgnnntncgntttatactggatagttgggaaagtagggccnngncggcagnnaaaatagcgtcctgcgctgaccgacgaagtacccgcgtctgttccgggtaccccgttccccccacaacgcggacgcgaacggacacacaccctaattctgcccctccctccacccggaggcgacagaggaggcacacaccaaggtacgcggggagaagaccaccggnncgacagacgacanaccncgcacataacacggtccaattcccctataacaactcgcnccggcacgagattacttctcccctggctcctcantcctaacgaggaacaccttccccccgctcactccgcggggaacccgcctcaccgcttacaacgcccccgacgctaccaaaatatactcggactcgccacanctacgncccaancggaaaagagtatggaggtaaggtaacaaaaggagagacaacatgttcntaatcgcggcgaattgcggtccaacatctcacacatacgcgaccncgacccgccntcacacacatatataactcttttccgtcattctacaccccctcagataacccctctctccaccccctcttagttataagcgcgcnaccaccagctacgcccctgnggggc

SEQ ID NO: 88036 - protein, 40 aa, Zea mays
  misc_feature: Ceres CLONE 1575239
  misc_feature (27)..(27): Xaa is any aa, unknown, or other
MAAALRFPGVARESLSLDAPVAASKLXRERRPVPASANLG

SEQ ID NO: 88037 - DNA, 925 bp, Zea mays
  misc_feature: Ceres CLONE 1575242
  misc_feature: Encodes the peptide sequence at SEQ ID NO. 88038
  misc_feature (742)..(742): n is a, c, t, g, unknown, or other
ctggagctccccgcggtggcggccgctctagaactagtggatcccccgggctgcaggaattcgtctcacccctagaaaaaacacgaggctgaacgcttgaacctgaacctccaaagcagcaaccccagcagctttagctcctcctcatcgcagccgcagcgccgtcccctactcttccagcgaccaactgctgtctctccggcgacggcagaaccgtctctgcaggtgcagggagggacccgggagatgagtctggggctgctcaacacagagcgcaaccaccttctctccccgaagccgcagagccctcgggatgccgccgtgtcgtcgctgctgaggtcacccagggcgtcctgcggctcctgcagccagagccccaagccgaagcccaccaagatggcgcacggcggcctggagcgctcgctcagcttcaagaactgggaggcggacgacagccggggcggcatcaacggagcgcgcccgggcgccctggcgctgcagcagcaggagagcccccggcgcgtggtctccgtgtccccgcaggcgcaggccatgatcgagtacatctcccctcgcccccgcgtggagctggaccaggcggccaccacgctgcagaagatgtacaagggcctgcgcacgcgccgcagcctcgccgacggcgccatcatcgccgaggagctgtggtggaaacggtcgactcggtgtacctcacatcaagtccatctcccttctcgacgagacnagcaggagacgccgcgtcccgctggtcagggccgtgctgagatcgcaaggtcggcaggggctctccatgacgacaggcgcagatctcgcgctcagcactgctcgagctattgaccgcgcacgctacggcacaactgatcctactagaatctgtccgcagctcagctggagcctctttactggt

SEQ ID NO: 88038 - protein, 202 aa, Zea mays
  misc_feature: Ceres CLONE 1575242
  misc_feature (166)..(166): Xaa is any aa, unknown, or other
MSLGLLNTERNHLLSPKPQSPRDAAVSSLLRSPRASCGSCSQSPKPKPTKMAHGGLERSLSFKNWEADDSRGGINGARPGALALQQQESPRRVVSVSPQAQAMIEYISPRPRVELDQAATTLQKMYKGLRTRRSLADGAIIAEELWWKRSTRCTSHQVHLPSRRDXQETPRPAGQGRAEIARSAGALHDDRRRSRAQHCSSY

SEQ ID NO: 88039 - DNA, 1029 bp, Zea mays
  misc_feature: Ceres CLONE 1575244
  misc_feature: Encodes the peptide sequence at SEQ ID NO. 88040
gaaagctgaagctcaccgcggtggcggccgctctagaactagtggatcccccgggctgcaggaattcgtctcacccctagaaaaaaatttccgctcccctcacgagcatttcccccgcctacccgtcgccgacggccatggcccacctccagctcacggcgctcgccggcggcgccgacgacgagatggaggaggtcgcgctgctgggatcctacgacgaggaggccggggtggggccggaggcggagggggaccgggcggaggccggcatgcggcgggtgcaggtgcgcgtaaccggcatgacgtgctccgcgtgcacgggagccgtggaggccgcgctctccgcccgccgcggcgtgcgccgcgcccgcgtgtcgctgctccagaaccgcgcccacgtcgttttcgaccccgcgctcgccaaggtagacgacattgtagaagcatagaagatgctgggctcgaagcagaaattcttccctgactctaccgtttcctcaccaaaacccgcataagactttgtcaggaccatttaggatagggggggatgaccttgtgcctgcttgtgtgaacccgggttggagggggtccttaaaaaaaattgccggggggaaaaaaggggcatttggttgctttatccacccccctttggggggaaagtgggaaaagaaacccctccgccccttagcaaaaagaaaaaatttgtccgggccacccaaggaaacccgggtttttaacccccccccggttcacaaaatatggcccaaaaaaggggccctttttaattgtccggggggttttattttccagaaaaaaaataaaatttttccccaaaaacccccaaaaaaaaaggggggggcggccgccccccccggggaaatattttcacaccccaacaaatgttatttgttttctccccccataaatttggtgtgtgaaaaactttttgtatttctctccggggggaaaaaaaaaggggaggaacaccttgtgtgggctatctatattcaccgcgccttaaatggacga

SEQ ID NO: 88040 - protein, 103 aa, Zea mays
  misc_feature: Ceres CLONE 1575244
  misc_feature (49)..(104): Pfam Name: HMA Pfam Description: Heavy-metal-associated domain
  misc_feature: SWISSPROT Homolog: EC 3.6.3.4 Copper-exporting ATPase
MAHLQLTALAGGADDEMEEVALLGSYDEEAGVGPEAEGDRAEAGMRRVQVRVTGMTCSACTGAVEAALSARRGVRRARVSLLQNRAHVVFDPALAKVDDIVEA

SEQ ID NO: 88041 - DNA, 911 bp, Zea mays
  misc_feature: Ceres CLONE 1575245
  misc_feature: Encodes the peptide sequence at SEQ ID NO. 88042
  misc_feature (618)..(618): n is a, c, t, g, unknown, or other
  misc_feature (902)..(902): n is a, c, t, g, unknown, or other
ctggagctccccgcggtggcggccgctctagaactagtggatcccccgggctgcaggaattcgtctcacccctagaaaaaacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcggccagcaatggaactatgggctcgaggctggctccaagccagaactgctcatcgccatgagctgcctccccgtcaccgaagccgagcccaagcggtacttgatctgncacggctacagggacgcggactacatcgcgctcgcgctctcggcgcgggccatgggcctgaaccccatcatcgtgctcgagatggaggaagagctttgcatcgtcctcgacagtacaagagctgcagcagagctgccagacgacgatgccgtgcgcaagagttcgagccggtcatcggcatccgcgccagcttctcacaagctacaggccactttcgttcgacggcggcaagccggcaagttcgggatgctcgcgacccgatctacaaggtggcgaaacctcgncaaggaggc

SEQ ID NO: 88042 - protein, 253 aa, Zea mays
  misc_feature: Ceres CLONE 1575245
  misc_feature (73)..(253): Pfam Name: Orn_Arg_deC_N Pfam Description: Pyridoxal-dependent decarboxylase, pyridoxal binding domain
  misc_feature: SWISSPROT Homolog: EC 4.1.1.19 Arginine decarboxylase
  misc_feature (156)..(156): Xaa is any aa, unknown, or other
  misc_feature (251)..(251): Xaa is any aa, unknown, or other
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDMVRFGQQWNYGLEAGSKPELLIAMSCLPVTEAEPKRYLIXHGYRDADYIALALSARAMGLNPIIVLEMEEELCIVLDSTRAAAELPDDDAVRKSSSRSSASAPASHKLQATFVRRRQAGKFGMLATRSTRWRNLXKE

SEQ ID NO: 88043 - DNA, 936 bp, Zea mays
  misc_feature: Ceres CLONE 1575246
  misc_feature: Encodes the peptide sequence at SEQ ID NO. 88044
  misc_feature (668)..(668): n is a, c, t, g, unknown, or other
aaagctggagctcaccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatggtggtgtccactcccgccttgaccaactgcagttacttctgaaaggtgtcagtgagagaggagcaaaaaaaattcgtgtgcacatccttaccgatgggcgtgacnttttggatggcagcagtgttggtttcgtggagaccctagagaatgatcttttggagcttcgaagcaagggtattgatgcacagaatgcttctggtgggtggaaggatgtatgttacattggaccgttttgagaatgactggggatgtgggtaaacgtggctgggatgctcaagtgctccggaaaacccccctacaaattcaaaagtgcccttgaggctgggaaaaccctgaaagcacagcccaatgtctaatgacaatacctggcccc

SEQ ID NO: 88044 - protein, 211 aa, Zea mays
  misc_feature: Ceres CLONE 1575246
  misc_feature (15)..(210): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (169)..(169): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDXLDGSSVGFVETLENDLLELRSKGIDAQNASGGWKDVCYIGPF

SEQ ID NO: 88045 - DNA, 922 bp, Zea mays
  misc_feature: Ceres CLONE 1575248
  misc_feature: Encodes the peptide sequence at SEQ ID NO. 88046
  misc_feature (658)..(658): n is a, c, t, g, unknown, or other
  misc_feature (661)..(661): n is a, c, t, g, unknown, or other
  misc_feature (718)..(718): n is a, c, t, g, unknown, or other
agctccccgcggtggcggccgctctagaactagtggatcccccgggctgcaggaattcgtctcacccctagaaaaacccaccggagccgtagcgaaagcgagtcttcatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcataatgcatncgntaggggagcgttccgccttagagggaagcatacgcgaaagcgggggtcgacgatgcngaagcgagatgtcggcttgagtaacgaaacattggtgagatccatgcccgtaatccatagtttttctcgcatgtcgtccccggaagggtgatcagggcttaatcaagccctagggcttatctatggaaaacgggaatattccgttcacccctttttgtccaggggccgaaaagcctgttttccaaaatgtgttttgttttagaa

SEQ ID NO: 88046 - protein, 59 aa, Zea mays
  misc_feature: Ceres CLONE 1575248
MPLEPRASWFSPKCVEAQQLTGHLGVKHCFGAGCASGTKSRQTLNTRYDPKITGVKVGQ

SEQ ID NO: 88047 - DNA, 1333 bp, Zea mays
  misc_feature: Ceres CLONE 1575255
  misc_feature (68)..(68): n is a, c, t, g, unknown, or other
  misc_feature (489)..(489): n is a, c, t, g, unknown, or other
  misc_feature (492)..(492): n is a, c, t, g, unknown, or other
  misc_feature (838)..(838): n is a, c, t, g, unknown, or other
  misc_feature (896)..(896): n is a, c, t, g, unknown, or other
  misc_feature (964)..(964): n is a, c, t, g, unknown, or other
  misc_feature (1046)..(1046): n is a, c, t, g, unknown, or other
cgtgcgttgtctattttgattgtgtgggacgtgaggtgtgcaggcgtcttgttggtgtgtggggtgtntctaagctggagctcaccgcggtggcggccgctctagaactagtggatcccccgggctgcaggaattcgtctcacccctagaaaaaacgtcagcccatccgattcctcgccgccgccgccgccatgcttctcctttcctccgccatcttcaccaccgcacgcctcccactcgccgtctccgctcgcctcccaaaccctacgaacacgacccgcctcatcttcgccggcctacctgcctcctccccgggtcgtgccttctgccataggggagccacttaccctccacttgttccgccttctcctccaccatgggccgcctccgagaacccccttctcgactgccgagttctagtttcttgccttcgacggcggcaaccccacccacaacacatcccggttttgtgtgtgtggtttgagtaantanagagcccaacttatataagctcgagaatgatttcaaaccccacgtgggcataagtcagttccaatccgctgggaatcgaattctccgtcaaggctctgaggtgatatctgggggcatgacattatataaccgtgaagtcgcccccaatttactacccgcttgaactctccgacagcccgtccgttgagagggagatctgattaactccggccagaatgtgcgttgttctctgcaccaccccatggtgttatcgggagtacgtacgctgtggtctcttttccgccagctgtaaacgcatgacgctacgcggactcctttcccgtggtgtaccgtccgccgctggtanattattagggagtgactaagagccttcgataatgccgcggttcttggagagtggtacnatggtcaacatctactctcaggctcggatgaaatgcgttcttgcactcactttcaatagttgtgcagnggtgtgtgtgcgctatccactgcttattctctctgcgttcccgcgcgtcggcggttggggcgtggtgatcatccgtcacgcnatgggtcatcataaaattcatttgcacctgactcgcgtctgtcgcagctatcacagagagccagtttatagaatagaactctgtgtcgcccaaatacaaagaggtgtgaagcaattacacaaggtacaagttacgacgggatgcttctccctctccgctacttgacagatacgtataatttcaaagatgtaagactggtgctggctatccagattagagaggcatattttccacttgatgtgtgtgtacgcttctacagttgacgatttctgttgtgtgtgtccgct

SEQ ID NO: 88048 - DNA, 945 bp, Zea mays
  misc_feature: Ceres CLONE 1575259
  misc_feature (708)..(708): n is a, c, t, g, unknown, or other
ctccccgcggtggcggccgctctagaactagtggatcccccgggctgcaggaattcgtctcacccctagaaaaaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctcgggggtcgcagtgaccaggcccgggcgactgtttaccaaaaacacaggtctccgcaaagtcgtaagaccatgtatgggggctgacgcctgcccagtgccggaaggtcaaggaagttggtgaactgatgacagggaagccggcgaccgaagcccccggtgaacggcggccgtaactataacggtcctaaggtagcgaaattccttgtcgggtaagttccgacccgcacgataggcgtaacgatctgggcactgtctcggagagaaggctcgtgaanagacatgtctgtgaagatgcggactacctgcacctggacagaagaccctatgaagctttactgttccctgggattggcttttgggcttttctgcgcagcttaggtggaaggcgaataagcccccttccgggggggcccgtagcatcagtgagatccactctggaagactccgattctaaccttgtgtaaacccccgggccaagggacaatctcagtaaacatttcttatgggcgtag

SEQ ID NO: 88049 - DNA, 949 bp, Zea mays
  misc_feature: Ceres CLONE 1575260
  misc_feature: Translation starting site: 273
  misc_feature (754)..(754): n is a, c, t, g, unknown, or other
  misc_feature (805)..(805): n is a, c, t, g, unknown, or other
ctccccgcggtggcggccgctctagaactagtggatcccccgggctgcaggaattcgtctcacccctagaaaaaactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggtgtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcttatatgtgtgggagggcagtctcctcaacagtatggggaatcgtggctgataagtatggaaggaaaccagttatcgtactgacccttattgcatagttatcttcaatactatgtttggactaagctcaaactattggatggcattaatcacacgatgcctggctggaatcatgtgtgggtatctcggggccattaanggctatgctacagaagtgtgccgaaaagaatacatcatctggctttggcangtgtttcctcctcacgagcattggtctcattattggtccagcctattggtgtaatcctgcgcagctgcaaaaaatattcaagttaattctcccaacgccccatatttgggagtttccataactttcttcctggccgggaaatat

SEQ ID NO: 88050 - DNA, 1043 bp, Zea mays
  misc_feature: Ceres CLONE 1575263
  misc_feature: SWISSPROT Homolog: EC 3.1.2.15 Ubiquitin thiolesterase
ctaagctggagctccccgcggtggcggccgctctagaactagtggatcccccgggctgcaggaattcgtctcacccctagaaaaacgccaagaagtaaaatctattctgatagatgcacccgcaaatccagaggacgattcatacttttggatttcaacagactggcttcgccaatgggcagataacatcactcctccctcatccattgacaatggaccaattcaatgtgagcatggaaaagttccagtgtctaaactcacatcaatgaagcgactatcagctgcagcttggcagacattattttcaaaatatgggggccaacattgagcggtgatgatttttgcatggtgtgtcttaaagatggggcgaaatatgcagtatctgctgatccctatcgtgaccgcaaacacacatttaaaaaccttacagaagcagctcttgctggtagttgttcagataggccttcttacttcatctcaaaggcatggttgactcattggctccgcagaaaaaaatgcccggaatcctttcagatgctgataatgtgataaccgagtgctttaaagacgtcggccatggggtatccttcctgccggaatctttgctccagggacctaaaacgggggtatccgccaccattagaagccttgttggtatattttcctcctagccaaactcatcaatcgtagaaaggctggaatgaagggtggcttacttttttcccatctagaactgttacagaccatgtctaaaaatacggccaattgcggcatattggtcccaactttttgacttccttgttgaaggggtaatttatctctaaccactcattaaccgtggaggcaaaccaacccgcaacttgttgaaattatttttgtcctgggcgaaaaagcgtttgccgactttctgtttgggtgggaaaaatattatatctgcggcgttcaagacaacgttggtcgagaccaataatgctctaactccttattttcttcccccacctggatcaaaatattgtcttcgcccaccataatactctgaaacg

SEQ ID NO: 88051 - DNA, 859 bp, Zea mays
  misc_feature: Ceres CLONE 1575264
  misc_feature: Translation starting site: 194
  misc_feature: SWISSPROT Homolog: EC 3.1.3.16 Phosphoprotein phosphatase
  misc_feature (610)..(610): n is a, c, t, g, unknown, or other
  misc_feature (729)..(729): n is a, c, t, g, unknown, or other
  misc_feature (763)..(763): n is a, c, t, g, unknown, or other
tccccgcggtggcggccgctctagaactagtggatcccccgggctgcaggaattcgtctcacccctagaaaaagtctctctccagtcttcttcaccaccctgcttcctccctcttcctcttttgtttcatcagagagaaaaaaaactagatttagcgagggcggaccgacgacgcagtagaagcaaccgagacatggagcggcggaggaaggcaatgtggctgtaccccaaggtggtcggtttcaacccgccggagaggtggggccactccgcctgcttcttcgaaggcttcgtctacgtcttcgggggatgctgcggcggcctgcacttcggcgacgtgctgaagctgaacgtggagaccatggcgtggagtcttgtggccacgacggggcagtgcccgggcacgcgggacagccacggcgccgcgctggtgggccaccggatgctcgtcttcgggggcaccaacggcggcaggaaggtgaacgacctgcacgtgctggacctgcgcaccggggagtggacgcgcccgcagtgcaagggcgcgccgccgccgtcgccgcgggagaccacaccgtcaccgtcgtcgggggcgaccgcctcgtcgtcttcngcggcagcggggagggcgatggcaactacctctgcgacgtgcacgtgctggacgtgcccaccatgacgtggtcctcgcccgaagtcaggtgctggcacgcgcccgcgcccaggtacagncacagcgccgtgtccgtccggcgcatgctcttcntcttcggcggggactgcggcgacggttacacggcgacgtgaacgtgctcgacgtcaacaccatggcgtggcaattgttccggtgaaggtgcatccc

SEQ ID NO: 88052 - DNA, 952 bp, Zea mays
  misc_feature: Ceres CLONE 1575265
  misc_feature (523)..(523): n is a, c, t, g, unknown, or other
tggagctccccgcggtggcggccgctctagaactagtggatcccccgggctgcaggaattcgtctcacccctagaaaaagcacgcctcactctgctctctctctctctctctctctctccatagtccatactacaaagcaggaaaaaacacacacacacaaaagaaaggctcacaatacccacctccatttagctactactactccctcgctgtcttccgcaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctgggggggccaaggagcggcgcccgatgagacggcgccgcatgaacccacattgccagccaccggctccggcgctaccggcgcgccggcggtcgggggcaactccaactccgtgctggtggcgctgctggattcncactacacggagctggcggaacttggtggaaaagcgctgctcctgcaaacgcttggagaccccgtcggggaacacaaactcaccattttcccgccccggaacaaggcgcttgaacgggacctgaacccggaattaaacgccttcctgtggaaaccccacaacctcgggtcctgaaagggcctgttgtttaaaaagttctccccctgggcctccttcaaaatctgggccgggggggcccaccaaccttttccgggaaagaaatttaatttgtgcccggatttgtttttggcaaaccccttttaaaccccgaaacacgttttttgccccaaggggttcccccgggattaggccccctctgggccggcccttgtaaagaaactaaaaccccccccaccccccgggataatttcggtgttccacaagggtgga

SEQ ID NO: 88053 - DNA, 857 bp, Zea mays
  misc_feature: Ceres CLONE 1575266
  misc_feature: Encodes the peptide sequence at SEQ ID NO. 88054
ctggagctccccgcggtggcggccgctctagaactagtggatcccccgggctgcaggaattcgtctcacccctagaaaaaaagtcgtcgcctcggcccggcttcgcctccctcggcgcgacgacctctcccccaggagagcctaccccctccctcattccccgcgcgacgaggccgcttaatggagggtcgcggccggcctcggccgggctcgctccaggctctcgtcgtcgccgccgccatcctcctcctggccgccgtgtccggggtcggcgctggatcccccgatcggcccgcgccggggccaccgctgttcctcccgctcacgcgctcgtaccccaacgccagccggctcgccgcctcgctgcggcgcggcctcggcgacggggtccaccccaacgcgcgcatgcgcctccacgacgatctcctcaccaacgggtactacacgacgaggctgtacatcgggacgcccccgcaggagttcgcgctgatcgttgactccgggagcaccgtcacctacgtgccctgctcctcctgcgagcagtgtggcaaccaccagatccacgatttcaacctgacctctccagttcatattcaccagtaaaatgcaacgttgattgtacttgtgacagtgacaaaaacagtgcacttatgagaggcagtatgctgaaatgagctccagcagtggggtgcttggtgaggacatagtgtcttttggcagagagagtgaacttagcacagcatgctatttttggctgtgaaatctgaaactggagattggtcagtcgcatgctgatgtataagggggcctgggtcgtggtcacttagcatatggatcagcttgtttgaaagggggct

SEQ ID NO: 88054 - protein, 140 aa, Zea mays
  misc_feature: Ceres CLONE 1575266
  misc_feature: SWISSPROT Homolog: EC 3.4.23.4 Chymosin
MEGRGRPRPGSLQALVVAAAILLLAAVSGVGAGSPDRPAPGPPLFLPLTRSYPNASRLAASLRRGLGDGVHPNARMRLHDDLLTNGYYTTRLYIGTPPQEFALIVDSGSTVTYVPCSSCEQCGNHQIHDFNLTSPVHIHQ

SEQ ID NO: 88055 - DNA, 962 bp, Zea mays
  misc_feature: Ceres CLONE 1575267
  misc_feature: Encodes the peptide sequence at SEQ ID NO. 88056
  misc_feature (785)..(785): n is a, c, t, g, unknown, or other
catagctggagctccccgcggtggcggccgctctagaactagtggatcccccgggctgcaggaattcgtctcacccctagaaaaagcctctcgccgccccgcctctcgccgcccatttccctccgccgcctcctaatcctcaacacccgcgcccccaaccgcgcccgtcgtatgccaccatgcaccgcgcccgccccaccgcgcacgctaatgaccccgatgctccgtacgccgccgccgtcgcgatgctgctggagcccaaactcaaggacgaggagttgccgatgcagcagctggcgtccccgggccccttcgtgtccctggaccagctgatgccggcggtggccgtgccggccgaaccgcgcccgctggaggcgctgctgcaaggcccgcagctgccgcccttcctgtccaagacgtacgacctggtgaacgagccggcgctggacggggtcatctcctggggcgctgccgggaacagcttcgtcgtgtgggacccctccacctgcgcacgcgacgtgctgccgcacaacttcaagcacaacaatttctccagcttcgtcaagcagctcaacacctatggtttctgcaaggttcatgctgacagatgggagtttgctcacgaagatttcctgcgagatagcaagcatctattgaagaggattgtcaggcgcaagtcctccccaacaaacaaagcagcgttcagcctggctcttcttctcgagagtccagcttggaccctgagctcacacgctgaagagagagagacgcgctgcttgaagaantagcaagggtgaacatgaacccgccagacattgagcaaatgacacgctgatcacatgctggatctgctaagaccgcataagcagatgtctctttcctgccagctccttcaaaacccagtttctgagaactgacctgacagtaaatacgaatcgctccccaggagaagaagttccaaa

SEQ ID NO: 88056 - protein, 179 aa, Zea mays
  misc_feature: Ceres CLONE 1575267
  misc_feature (52)..(178): Pfam Name: HSF_DNA-bind Pfam Description: HSF-type DNA-binding
MLLEPKLKDEELPMQQLASPGPFVSLDQLMPAVAVPAEPRPLEALLQGPQLPPFLSKTYDLVNEPALDGVISWGAAGNSFVVWDPSTCARDVLPHNFKHNNFSSFVKQLNTYGFCKVHADRWEFAHEDFLRDSKHLLKRIVRRKSSPTNKAAFSLALLLESPAWTLSSHAEERETRCLK

SEQ ID NO: 88057 - DNA, 956 bp, Zea mays
  misc_feature: Ceres CLONE 1575268
agctccccgcggtggcggccgctctagaactagtggatcccccgggctgcaggaattcgtctcacccctagaaaaattctggtcacttcttttggggttctccgttcccctccccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctctcttttgagagagggggaagtaataaaagggaaaaagctagcaaggggatttccttgatcccatcatcgtgctacagatcctttagttctagcaaggaggaccaaaaagagagagcaagcccatggatcccagccagatgatagttccccatctggggggcgccgcctcccgccgcctttgaagccgccctccgatgatcacgccgccgcccccaacgcgcaggcgcagcccttcctcccccctccctatcccaaccgcggctggaagcgcaagaatcccgccgccgccgccttacagccaccggccctcggcgatctccaagtgcaaaaaccgcgcaaggctcgccgctggttcaaaacagcggcggcgggaatccctaccaaagcggaagtttttcttccccaaaacaagaacaacaagggtcgcgcgccgcgcaacaacacctcctttatcatcccgggcaagcgcggcgggcggatttgctccctcgtttccccttgcccgttcacgccggcgtgcttcccaccccggggttctccccctctcgcgaggagctaactgaattggcccaggccaattggggcgtctatgggtacgctcatgtaagggcccaatcggcttcgtatttccccccagcaggcaacccaatggtggcgcatcagagaa

SEQ ID NO: 88058 - DNA, 909 bp, Zea mays
  misc_feature: Ceres CLONE 1575269
  misc_feature (883)..(883): n is a, c, t, g, unknown, or other
ctggagctcaccgcggtggcggccgctctagaactagtggatcccccgggctgcaggaattcgtctcacccctagaaaaacatccatccatcctctcgctcgcccttcaacagctagctaagcagtacgacatactatactagcatttagcagttcatgaacgcgctcaacctagcaggacgtacggcgatgaggcgccgcggcagcaactcctcgccgcttgcggctgctgccctgcccctcctactcctcctcgtcgccggctgcttccactgcgcggcaacggcagctcgccacctgccttctcctggcgccccagtccaagcgctggatcaccaagccgagaacggtgccaaagctgcatcagctggtgcagacggcgccggcggccttgtgctccacgaaggtggcacgggcaacaacggagacgagctctcctccaacaccaccctcctcgagacgacgactacgatgggagcggaggcgtgcgacgacgggaacggcaaggactagtgcgtgctgaggcggctgctcgtcgacgcgcacctcgactacatctacacgcagcacaagggcaagccgtgaccgtcagcgacgaggacggtgccgcggctgcagctgcagaaagcgatgagcgagaaattgaccacctcattcctcaaactaaacatcttataaattcataccgacggcgatggtaatctcatctgctgctactagctactagtacatgcatcgatccaccttctgcatgtgctgtatatttctgccacgctgcctatatattagcatgcatcatcatctaagtcaaggactgtctgatggtttcccgtatatgtaacactgatgaacagtacctgtctgtctctctgctacctgtaancaccaagctactgaggtcaagaaacg

SEQ ID NO: 88059 - DNA, 855 bp, Zea mays
  misc_feature: Ceres CLONE 1575270
  misc_feature: Encodes the peptide sequence at SEQ ID NO. 88060
ggagctccccgcggtggcggccgctctagaactagtggatcccccgggctgcaggaattcgtctcacccctagaaaaaagcaagccattattgagtatagcacagaaaatctgcagccaccaattctgacgatagaagatgcgatccaacgaaacagctacttccaagtccccccatttgtagctcctaagccagttggtgattacaacaaagggatggctgaagctgatcaaaagattctatcagcggaggtaaaacttgaatcccaatactatttctacatggagacacaagtggcgctagctattcctgatgaagataactgcataaccatctattcttcgacacaaattcccgaggtcacacaaaatgtggttgcaaagtgccttggcattccatttcacaatgtccgcctcatcaccagaagagtcggaggaggctttggtggaaaggcaatgaaagcaatacatgttgcatgcgcatgtgcggttgctgcattcaagctgcggcgtccagttcggatgtacctcgatcgcaagacagacatgataatggcagcggtcggaatcctatgaaggtgaagtactctggtggggtccagtcagatggcaagatcacagccttgcacattgatcttgggatcatgctggaaatttcaccgatgggagccctatggttgcacctggctaccataggtgctcccaaaaaggacaactgggggcaatcttgcattttgaaccccaggcctgcaaaaaaaaaggcccctcaaaatcccccattaaggggtccctggaaaaatttcagggcccttttcccccgggaaaacccccttttggaaagtgttgcccaccacct

SEQ ID NO: 88060 - protein, 119 aa, Zea mays
  misc_feature: Ceres CLONE 1575270
  misc_feature: SWISSPROT Homolog: EC 1.2.3.1 Aldehyde oxidase
MAEADQKILSAEVKLESQYYFYMETQVALAIPDEDNCITIYSSTQIPEVTQNVVAKCLGIPFHNVRLITRRVGGGFGGKAMKAIHVACACAVAAFKLRRPVRMYLDRKTDMIMAAVGIL

SEQ ID NO: 88061 - DNA, 835 bp, Zea mays
  misc_feature: Ceres CLONE 1575272
  misc_feature: Encodes the peptide sequence at SEQ ID NO. 88062
  misc_feature (388)..(388): n is a, c, t, g, unknown, or other
  misc_feature (452)..(452): n is a, c, t, g, unknown, or other
ctccaccggcggtgggcggccgctctagaactagtggatcccccgggctgcaggaattcgtctcacccctagaaaaaaggcgtacgcgctctaccgcgccggcttcgcgggcgtgccgctcaacctcgcagccatcggcgacctcttcgccgccagccgcttcatggtcgcgcacgccaacaacctctccaccgctgcagccccggccaccgggcagccgctgctcgtgccgctccagtgcggctgcccctccgggtcccccaactcgtacgcgccgatgcagtaccagatcgcgtcgggcgacacctactggatcatctccaccaccaagctgcagaaactcacgcagtaccaggccgtggagcgcgtcaacccacgctggtgcccnacaaactcgacgtcggcaccatggtcaatttccccatctttctgccagatgcccggccggccgnctaacaacgccacccggggttcgtaaccttaacttcagtggagccccggaaaaaaccttactggaaacattgggcgcccgcctttttccggtggaaaaccccaaggggcctgggttcccccttaaagggggccccaaacccagagagaaccctctttttccccccaaaaaaacctggtggccccttccccccccccaaagtggccccgggttgggttttcccccccccaagggggggccccaaaaaaaaaaacccccccccccagaaaaacccggggggggccccccccccccccctctgtgttttttccccaacaaaaaaaaaaaaacgttggtgtgaaaaaaaaaaaccacccccgaggggggggggggggtggccccacc

SEQ ID NO: 88062 - protein, 104 aa, Zea mays
  misc_feature: Ceres CLONE 1575272
  misc_feature (97)..(97): Xaa is any aa, unknown, or other
MVAHANNLSTAAAPATGQPLLVPLQCGCPSGSPNSYAPMQYQIASGDTYWIISTTKLQKLTQYQAVERVNPRWCPTNSTSAPWSISPSFCQMPGRPXNNATRGS

SEQ ID NO: 88063 - DNA, 952 bp, Zea mays
  misc_feature: Ceres CLONE 1575273
  misc_feature: Encodes the peptide sequence at SEQ ID NO. 88064
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (888)..(888): n is a, c, t, g, unknown, or other
ctggagctcaccgcggtggcggccgctctagaactagtggatcccccgggctgcaggaattcgtctcacccctagaaaaaactcgtcgggcccaaagcggccaagcccaccactccacgtccagttctccacacacacgtgaacactaaccctaagcccattccctcggtggctgcctggctggacgcctgtcgcctggacacctccaatccccagaccccaggcttcaccgcttcagccccgccggcgccgagcggccgactcgccgacggccgactccaatccctaggcttcagccccgccgagcggccgactcgctgacggccaactcgcacgtgtttccgccggcagcctggcacagcaagcaggaagcagcaagcaagaatcagcggtcgggcgggcgtacgacagcaagcaggaagcagcacaggcgtctccatcctacagcagttgagactcgatatgtctcactctggaacaggacccggaggaggagcacaccatttagactctattaattgttattgtgtatggactgaatttatgtgggcagagtgagtgtaagtttacttgttggatacttggatttggaattgtgttatgtgctcatgtactattgtggacttattttcatgttgttcaatggctatgtggtcaactggtcatgtnnnnnannnnnnnnnnnnnngntnannnnnnncnnnnnnnnnnnnnaanannnaaaaaaaaaaaaaaacccggggcccaaacaaacattgtttcacccccgggtgaaaaaacggaaaaaacggggagaaacaaaaaaaaaaaatccgggaagaggaacctccggcccggaccggacgttatccggacccccttccggaatattgtacaggcatcccaaanggccccggggtgtttaatccgctccgcgcctaggaggttctccccttaaccgaacggtggactc

SEQ ID NO: 88064 - protein, 31 aa, Zea mays
  misc_feature: Ceres CLONE 1575273
MSHSGTGPGGGAHHLDSINCYCVWTEFMWAE

SEQ ID NO: 88065 - DNA, 978 bp, Zea mays
  misc_feature: Ceres CLONE 1575274
  misc_feature: Encodes the peptide sequence at SEQ ID NO. 88066
  misc_feature (501)..(501): n is a, c, t, g, unknown, or other
ctcaccgcggtggcggccgctctagaactagtggatcccccgggctgcaggaattcgtctcacccctagaaaaaatttccaaaacaaaacaaccccaagtccccaacccagtttcaaacaaactagatccgcggcgaccatgcggcgcggcggcggtcgccggttccccaagccctccttggcgccctccaccgcggccgaggccaccccggcgctggacgccagcgtcatccgcaacctcgactccgccttctcccgccgcgactccgacgccaacagcctctgcagcagccgtcccgcttctaccgtcggcgccatcctcaacttctccgtacgcgccacgcaggtcgccgcgctccgcgtcgtcaacacattcctcgccccccgcgtcacgctccgggggggctctgccccgcgcgcgcgacatccaggcggcgctccgcctcctcgtcgaccgtcctcactttgccccgcaacgacggcacattgcgatgatgaccntcatccaggaatttccgccttctccgaagccccctacaaggtcacccggttccgaatttaagccccccgggacccccaattctggggcgggaagggctctcctaaccccatggggtaaccctccttggcccccccaagggaaaaacccggaatgccccaaggggccctcccgaaaaattttttggctttattcccccaggggttcccccctttttgggggggggaaaacccccccttaaaaacctcaaaaaaagaaaccccccccaaccccggaaaccggggaggggttttctttccacccccccccccccaaaaaagggggtgaaaacggcaaccccgtaaaaatttcttcccccccccccccgcgggaaacatttgtaaaaaaaagggcctttcttttttttttctttcccccggggggggggtggggaaaacatttattgaaaaaaaacccttgggtgagaaaaaaaaaaagaa

SEQ ID NO: 88066 - protein, 140 aa, Zea mays
  misc_feature: Ceres CLONE 1575274
  misc_feature (121)..(121): Xaa is any aa, unknown, or other
MRRGGGRRFPKPSLAPSTAAEATPALDASVIRNLDSAFSRRDSDANSLCSSRPASTVGAILNFSVRATQVAALRVVNTFLAPRVTLRGGSAPRARHPGGAPPPRRPSSLCPATTAHCDDDXHPGISAFSEAPYKVTRFRI

SEQ ID NO: 88067 - DNA, 896 bp, Zea mays
  misc_feature: Ceres CLONE 1575276
  misc_feature (414)..(414): n is a, c, t, g, unknown, or other
  misc_feature (429)..(429): n is a, c, t, g, unknown, or other
  misc_feature (430)..(430): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (453)..(453): n is a, c, t, g, unknown, or other
  misc_feature (456)..(456): n is a, c, t, g, unknown, or other
  misc_feature (483)..(483): n is a, c, t, g, unknown, or other
ctcaccgcggtggcggccgctctagaactagtggatcccccgggctgcaggaattcgtctcacccctagaaaaaattttctgaagcttgggcgggatctcggctcgcctccgtccatctctatggcgccacggggccaccacctggcggaggtggccctcctcgcctctgcttcggcggacctcgcagccgcaggcgccggcgagagggagggggtggttggacgaccccgccatcctcccctcgctcgggccccgcgcgcgatctctcgccgtggccagcgcggcgcactccgtgctcgtgatcgtcgcggtggcgggaggtggaggcggcggggtcacggtggagcctgcgctggggcccgacgagggccgaatctccgccgttgagtgggtcccgttcgccgggaagaccnaatgcagaagggganngagggggtngtnncgtggtgatnggnacggacgctggggtggctactgttctnctcgctccgctggcgatctttgtgcgcaagccgaagttatatccgggcaaagatactgaagcctccactgtcgtgagaagaaaggaaaaccgctcggggaaaatgtcgggcccaaaatgaacgttccggaagggtctcactgtttgtctttcgccccgcctttgaatggtgttcccctttccaaaaaggtcttaaaaaaaaactcttccacatgttaaatcccccccccggggaaaagataaatttggaagagccaaattgctgaaggataaagaaaacctttgtgaaaaaaaccccctttcggaaatgggcattgtaaacacctttcatgtcccgcgccaaaaggcgaaatttgttgccccgaagggccccttccctataaaaaacttccccaaaaaaaaaccggcccccct

SEQ ID NO: 88068 - DNA, 1039 bp, Zea mays
  misc_feature: Ceres CLONE 1575278
  misc_feature: Encodes the peptide sequence at SEQ ID NO. 88069
ctggagctcaccgcggtggcggccgctctagaactagtggatcccccgggctgcaggaattcgtctcacccctagaaaaaaacgacaacctccacctcgtcttcccctcctccgcgctcccgtcatctacaactctcgctcccacccacgagtcccaccggccaccgccaccaccaccagtctatcccctcgccatttgtttcctccccgtgcatgaaaccctaaaccaaaaccccacctccatccctgagccatcccctccagcgcggcgatggcaaaggcgctactttcctcctccctcctccccgcgctgcccggcgctgccggaggcagccggagcgctgcgaggccgatgctgctcccaccgctccggttgcggcgcggccggcgcgccgcctccgcttgcgaggtgagggcgggcctgcacgggctcgactccatcggcgggccccaccttcaggccgcgctggagcgcgcctagccggcgctatacacactctctgacgccacggtcgccgccgcgggcgcgggggccgaagcaagggcaggctgccgggggtccaaaaaaacagcgggggggttcggcttccatctccgaaggccccccaaggccgtggttaaaggtggctcaagggatggggcttttcaggcagtcccaaggggcccattaaccccctacgggttttggccaatacttatctggcccagttatcctgtgggtaaaaggctgggaaaaaatgggccctcaataccacaaaaagcggggggtggaaaataaacctccggggcaagtggaaaaattttacgggcccgcgaaattaaggggaatctcccgccaaaaatatccccaggcgaacccgggaaaagggtctcccctctagaacacggccgcgggtaaaaaaaaaaaaacgtggtgtgatacaccctctgagaagagggggtttccacagggtgatacacacaatcccgggtgagggagtgggcttacccaggcgccttttataaaggagcaataagaggggcttttgacaaagaagtt

SEQ ID NO: 88069 - protein, 69 aa, Zea mays
  misc_feature: Ceres CLONE 1575278
MAKALLSSSLLPALPGAAGGSRSAARPMLLPPLRLRRGRRAASACEVRAGLHGLDSIGGPHLQAALERA

SEQ ID NO: 88070 - DNA, 842 bp, Zea mays
  misc_feature: Ceres CLONE 1575282
aaagctggagctccccgcggtggcggccgctctagaactagtggatcccccgggctgcaggaattcgtctcacccctagaaaaacttcttcatagccaacccacccaatagggggtgggtgggtggttcccttgcgtcttcttccattctactagcttcataaaaggtggactgatggaagagcaaagttgtcaatctcagtaaaatcagcgtacatatgtcgtggttccttttctgaccatatataatatatatatgtaaaggtaataagttctgtttacagcaaaaaaaaaacctgcctcacgcttcctgttagaactctacgtcgcctcacactggtgctcctcctctccccatcgctccaccactcccatggcatccctcttcgggactggacgccggccatcaccggaagacgaccgcgaggactatagatccagcagaaggaggaccaagagcttccgcctctcctcggaggacgacacatcgtcccccgcggatgcggagcccggctcgacgacctagaccggttggatctccaggttcgtctaggaagacgagaaggtcatttcttccgtgtaactggtccacctcgcccaaggagacccggccccggggggagggacgaaggataaaggaaaagggtccccccaacaaccacccaaaattagggcctccccccccccgaaaggaaccttgaaaaactttcctctcgaaaacccctcccgagggaaaacaaaattgtgtttccttttttaagaggggggccctaagccccttttttatttgagagcccaagggggggggtttttggaagagaaaaaaaaaaatctcccccaaag

SEQ ID NO: 88071 - DNA, 933 bp, Zea mays
  misc_feature: Ceres CLONE 1575284
  misc_feature: Encodes the peptide sequence at SEQ ID NO. 88072
ctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagtgagtcctccgctgtccgctcctacccatgtgcatgcaacacaggctcgatcggccctcgtcttgccttcaacgagcagctagctagttagcctgccctgtacacggcacgccccaccaacagcttcacgacttcttctaagctgttctttaaacaccttgtttaaacaccttgtctaagctagttagccggctcttttgagttcgtcaccgaatgactgatacgaaggggcagaaaaaaaaagatgtccttttcgtcctactagctagtaccaggctttcggtaggtatttcttttatacaaggccagtgtttaatagaagctcgcagaaatgtctttttgaaaaggtcaaaagcgaggaaagcgaagccttttaggtgaaatgattagtgcaaatgacagatttagacctgtcatcatgttagagggctgcagaagaatgggatcctttggcagaatcagtagtacctcctattggcgtattacttgtgatgccccagggccagtttccatgtgcagatgtgctgctgctccccatactacaagcaaaaagctccacctccacgaaccaaaggcctcctgtgtctggaaaaagaaaacagccggaagtttttaaataaa

SEQ ID NO: 88072 - protein, 74 aa, Zea mays
  misc_feature: Ceres CLONE 1575284
MPINRIALGSHQEVYHPGALKAAFAEFISTLIFVFAGQGSGMAFSESSAVRSYPCACNTGSIGPRLAFNEQLAS

SEQ ID NO: 88073 - DNA, 1014 bp, Zea mays
  misc_feature: Ceres CLONE 1575285
  misc_feature: Encodes the peptide sequence at SEQ ID NO. 88074
tagctggagctccccgcggtggcggccgctctagaactagtggatcccccgggctgcaggaattcgtctcacccctagaaaaaaatccctggtcgctaggtagttcctgcgcctccatcccgatcccctgtctgatccaatcgtaatcaggatgctgccaggatcagagccggcggccggcggcaccggtatgttcgtgccggcggcgacagcgggcacggtgctctgctgcatgtgtggtgtgtccatgcaacccaacccggccaacatgtgcgcgcgctgcctgcgcgctcgcgtcgacatcaccgatagcgtcccgcgccacgccgccgtggtctactgccccgactgttcctcctacctccagccgccgcgatcctttctccgcgccacacccgagtcgcccgagctcatgcagatcctgctccgccgagtcaaccgcccactcgcgcggctacgcgtctccctctccggcgccgagttcgtcttctccgagccccactctaagcggctccgcctcaaccttccgcctcggccgcgaggtgctcccacggcatcgtcccccgaacagaaccccccccgtcgaagttcggtcgtccacaaaccgaattctgcggaattcctggctccccgggcggcggggcaaaacccccaatttagtggggtgccgccgttcgttccaaagtttccgcccagcactgttgcccccacccgaccggaaacctttttctcttaccttagaagagaggtccccccccaaaaaaaacggcgaggggttttcccttaaagagatacccaaagtcggggggggccccccggggggggcccaaaatttttttattgggtcggcgtgtccacagtgccgccgccctgggtaaaatttcttttcccccgttgtgttctttttccaaattcgtaagaaggataaatttctctctccccaacaaaccaaaaataccggcgttaaaaaaaaaagaaacctttttcgggaaaattaccccccttttgcgggag

SEQ ID NO: 88074 - protein, 211 aa, Zea mays
  misc_feature: Ceres CLONE 1575285
  misc_feature (26)..(199): Pfam Name: NMD3 Pfam Description: NMD3 family
MLPGSEPAAGGTGMFVPAATAGTVLCCMCGVSMQPNPANMCARCLRARVDITDSVPRHAAVVYCPDCSSYLQPPRSFLRATPESPELMQILLRRVNRPLARLRVSLSGAEFVFSEPHSKRLRLNLPPRPRGAPTASSPEQNPPRRSSVVHKPNSAEFLAPRAAGQNPQFSGVPPFVPKFPPSTVAPTRPETFFSYLRREVPPQKKRRGVFP

SEQ ID NO: 88075 - DNA, 1034 bp, Zea mays
  misc_feature: Ceres CLONE 1575286
  misc_feature: Encodes the peptide sequence at SEQ ID NO. 88076
aagctggagctccccgcggtggcggccgctctagaactagtggatcccccgggctgcaggaattcgtctcacccctagaaaaaaatgtaagaaatacacacaaaaaaaaagtcaaatcttaaaatggcgaacatgcgagcccctagaaacgatgacaaccaagagagtgcctccttcctcctaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtgggtggtcccccccccaaaccatgtgggcctctggaggactactacattccagattactttctgaaagcagggtgcccaaccaagtacttggttgatcatggcggcacccctgccccgttggtatgggtcattcaactcaagatctgggaggcccaacctgggaaagtagttttaattaaaaacattacgggggagcttcccaaaagaaacccaagggtttttggattcctcccaaaaaagggcctcccaaataaggggttttgccatccctttatttatggcccaaacccttgaaaaaggcgctaaaagaatgggaaggggaaaaacctttccttgcgggtttcaaaatttttggggggaacacgtggagggctaaattttttcccgggggggtggaatggtaacaccctagccggggctcccttggggggtgtccaagggaccccttaaggtttttccccccccccccccccgggggaaatgtgtcccccggggggaaccggaaataaaccccccccttttttttggggagggaaaaaaaaaaacccctcctcccaaaaaagggggtaaaaatctcccccggggttaaaaccggaaaaaaaaaaaaggtgtggtggggcatcttgtggaaagggatccag

SEQ ID NO: 88076 - protein, 105 aa, Zea mays
  misc_feature: Ceres CLONE 1575286
MEGEAETVGGPPPKPCGPLEDYYIPDYFLKAGCPTKYLVDHGGTPAPLVWVIQLKIWEAQPGKVVLIKNITGELPKRNPRVFGFLPKKGLPNKGFCHPFIYGPNP

SEQ ID NO: 88077 - DNA, 963 bp, Zea mays
  misc_feature: Ceres CLONE 1575292
  misc_feature: Encodes the peptide sequence at SEQ ID NO. 88078
  misc_feature (636)..(636): n is a, c, t, g, unknown, or other
ggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggagggtcacggcagcaaacactggggaggtctgctggaccccatcgacggcgtgctcctccaggagctcatccgctacggcgagttcgcccaggccacctacgacagcttcgactacgaccgccttctccccctactgcggnagctgcaagtacccggggaaaaactttcttcccagaacgtcgggcttcgggggaatcggggtaaaagggaacccggtaccttttaagcccctggaaaaaacctaaagtccccaaatttgggtttaaaagggccccaaccccaaaattggaaggaatcccgaccttttttcgggtattggggccgttcccccaaaaaaaaaaagggcggttttgcccccgggaaaattcccggggggggggcggcccctacccccccccggtgggggggggaaatatggagcaacaaaatcccccggggaaaagaggggccccccccgcaaacccaaa

SEQ ID NO: 88078 - protein, 156 aa, Zea mays
  misc_feature: Ceres CLONE 1575292
  misc_feature (129)..(129): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREGHGSKHWGGLLDPIDGVLLQELIRYGEFAQATYDSFDYDRLLPLLRXLQVPGEKLSSQNVGLRGNRGKREPGTF

SEQ ID NO: 88079 - DNA, 1022 bp, Zea mays
  misc_feature: Ceres CLONE 1575293
  misc_feature: Encodes the peptide sequence at SEQ ID NO. 88080
ctggagctccccgcggtggcggccgctctagaactagtggatcccccgggctgcaggaattcgtctcacccctagaaaaagagtcacccgcccccgccctagctcacacgccaagccccagtacaaacaaagcctacggaatttcccccagctccaattcgcgctgttcgttccctttcagccagtcagtcgccgcctccggttccgctgaacttgaagtccaaactagctagctcactgggcaccgattccccctaaaattttcgctgcttccaggaggccgcggcgaccatgggcaactgctgcgccgcgccgtcgacggagggaagcggcaagacccgccccaagaagcagaaagagaacccctacaacgtcgcgtacaaccgcgggggggcgccggtgcccccaggactggtggtgctgcaggacccaacaggggggggacctccgcgcggattacaaactggggctgacagctggagcgccgcgaagttcggcgttaacttacctgtggcacggaagcccgccaaggggagcggcgcctccgcgtggcaagtgcaatttccaaagcgcaagtttgcgcacgccccgtgggaccggggaagacgttgccgcccgggagggtggaattcattggcggcatatggccggccgcatcccccaacaattggttaagccctcccggggccggccttagaagggaccggaagacccccggtggcaccttggttcttggaagctctggccaagggaaggggaagctctttccaacgggatagtgcccccccgggaaactaaaccgaaggggccccggccgccgcccttatggcaaaaacatcgattgaagggccgccacaaattgcccaaggggatgggggtcttgcccccgggatttataaccggaggaatttttttatggaaaaaaggaaggttcccctccaaaaaaaatgattttggcctgggtggggttctatcgccggggagagaatttccggaattgagggggctctctttctgggccc

SEQ ID NO: 88080 - protein, 127 aa, Zea mays
  misc_feature: Ceres CLONE 1575293
MGNCCAAPSTEGSGKTRPKKQKENPYNVAYNRGGAPVPPGLVVLQDPTGGGPPRGLQTGADSWSAAKFGVNLPVARKPAKGSGASAWQVQFPKRKFAHAPWDRGRRCRPGGWNSLAAYGRPHPPTIG

SEQ ID NO: 88081 - DNA, 1112 bp, Zea mays
  misc_feature: Ceres CLONE 1575295
  misc_feature (419)..(419): n is a, c, t, g, unknown, or other
  misc_feature (692)..(692): n is a, c, t, g, unknown, or other
  misc_feature (930)..(930): n is a, c, t, g, unknown, or other
  misc_feature (971)..(971): n is a, c, t, g, unknown, or other
  misc_feature (1022)..(1022): n is a, c, t, g, unknown, or other
ggagctccccgcggtggcggccgctctagaactagtggatcccccgggctgcaggaattcgtctcacccctagaaaaagagagacagacacgcctctcccccaccacaagaacaccaaaggcacatcccatccatctccacggtgaggcttgagcgatccgagcaaaaaaaatcatccgcgacgcagcgacgcaggtttgttctctgatctctctggttcttcttttaggagcagggacgcacaacacaagaaaaggtccggttcaagaggctcttctgttgggtttttttagaatcctcaagagaagcgtgttcttgggttaggatttttttctcacctcataaaacctctcctcccacgaacagagatgcagagaacggtttttctcttctggatccttgcccccttttggcgagcnaaaggggggtgtttttgaaaaccccccctctgtgtttgattttccttgcttggataaaaacgcacccagctcctcccctttcctttgctgggaaaaagagttggggttttcccaaaaaaaaaaaatcccgtttgtttttttttattataagaaaaaccattttaaggccgcctgttttgtcgaagattccgtttctaggcctgaatttttttgtagggcgcccatcgcccatctgaagagtggtacacaggatgtttatcatacctctacccntctaggaatgtataaagcgcctcctaaggatttcccgccctcctgagaatttatggacagctcgccgtgagaataaacagtccgcttagccgtgtttgttcatacacgccgtgtcttccccacccttattgttgcgctccccccaccccacgatatcgttggggtgttatcgtagccccctcactatgccgggtgcgcccgagtattttctcatacacccttgtggacgccccttcantctaaacaccaacccgctccgttgcctgtatttctccagcncgccactattggaatacattgccaccgatagagttttacctgctccgttantctatgtgaatttagtgtccgcactcatgtcgggtccgcctagtgtgttgtgctcccgacttgatcttagtgctagacatattattcact

SEQ ID NO: 88082 - DNA, 947 bp, Zea mays
  misc_feature: Ceres CLONE 1575296
  misc_feature: Encodes the peptide sequence at SEQ ID NO. 88083
  misc_feature (498)..(498): n is a, c, t, g, unknown, or other
  misc_feature (571)..(571): n is a, c, t, g, unknown, or other
tggagctccccgcggtggcggccgctctagaactagtggatcccccgggctgcaggaattcgtctcacccctagaaaaagtccaatccgtttgtctccttgttcttcttcctcctgcggaagctcgccggtcatcggcaccaccgtggcaggatggcagtgccgacgaagccgagcccgccgccgccgccgctgcccacgctggagatgctacacggccagaccctagtggtcgacgtggaggcgtggatcctgcgcccgccggtgtccgccttcccgtacttcatgctcgtcgccgtcgaggccggcagcttcctccggggtcttctcctgctgctgctctacccgctgatgctcctcctcctcggcgacggcgcgcgggctaaggccatggccacggtcgctctcgtcgggctggaggagaaggaggtggccagggtcggccgagcagtgctgcccaagttcttcttggaggccacggcggcggagggcgtggcancggtgcaggcggcagcgcgggtggtggcggtgaccgcaaccttcccgagggtgatggtggacggatccctganggagtatgtcggcgtggacgccctcttgggcctgaagttgagtccgtgcggtgggtccttcgcggggctgatggaccattgagaccccaatgaagtgggcggcaaaaacccttcgggcctggttttggcaacaacttgaaagcggcaaaaaaaaaaggggcccgtgggggtcctccgaaccggcaaaacacggggagggggcccccccccttttatggccccttccacccgcaagggaaaactttccctttaaaccaaacccacaccccgggggaatgggacacccttccccccgggaaaaaataccccaaagagcttttctttttttccaaaaaggggcgtctcttttcttttgtggcccccacacgcccgcgtt

SEQ ID NO: 88083 - protein, 166 aa, Zea mays
  misc_feature: Ceres CLONE 1575296
  misc_feature: SWISSPROT Homolog: EC 2.3.1.15 Glycerol-3-phosphate O-acyltransferase
  misc_feature (116)..(116): Xaa is any aa, unknown, or other
  misc_feature (140)..(140): Xaa is any aa, unknown, or other
MAVPTKPSPPPPPLPTLEMLHGQTLVVDVEAWILRPPVSAFPYFMLVAVEAGSFLRGLLLLLLYPLMLLLLGDGARAKAMATVALVGLEEKEVARVGRAVLPKFFLEATAAEGVAXVQAAARVVAVTATFPRVMVDGSLXEYVGVDALLGLKLSPCGGSFAGLMDH

SEQ ID NO: 88084 - DNA, 941 bp, Zea mays
  misc_feature: Ceres CLONE 1575297
  misc_feature: Encodes the peptide sequence at SEQ ID NO. 88085
  misc_feature (704)..(704): n is a, c, t, g, unknown, or other
ctggagctcaccgcggtggcggccgctctagaactagtggatcccccgggctgcaggaattcgtctcacccctagaaaaaaattcccttcactccccgaagtccccactccccaaagctctctctctacctccctccccctcttccgaggcttctcctttccgccatggcctcctgctagtgccagcccccgtcgcaacgcctcccagatcccggacgcagcgtgccgcaccccgcgacggccggctcgcgacatgggagggtgtcacgcgaagccgctcacccacgacgcggaccgctcgccgccgcacgcagcgccggcgaccccgcccccgggctccgccacgcccgccacccccggccccgggaagaagcactgggcggtgtccccgttcttcgcgttctccacgccgagcccgagccccgcgcaccacctcttcggcggttccgcggcgtcgccgcgcaagtcccccgctccgcagggctccgcgcccaccaccccggccaggcggctcctgaggctgcccttcccgcccccgtcgcccgccaagcacatccgggcggcgcttgccaggcgccacggcccgccgcggccgtctatccccgaggaaggcagcggctagggggagggcggcggcggcggatgcaggggcctcgacaaggggtttgggttcaacaaggggtttgcggccaagtatgacttgngggatgaggtcggacgggggcacttcggctacacctgcgccgccactgttaagaatggcgcgcgcaagggggagtccgtcgctgtcaagtcatcccaaagcaagatgactactccattgctatagagatgtccgaagggagttaaatcttgaagctttagcagaacaaaaactggtcatttatgatgctaccagacacgacacgtgtataagtatggactgtgcaaagggaaacact

SEQ ID NO: 88085 - protein, 122 aa, Zea mays
  misc_feature: Ceres CLONE 1575297
MGGCHAKPLTHDADRSPPHAAPATPPPGSATPATPGPGKKHWAVSPFFAFSTPSPSPAHHLFGGSAASPRKSPAPQGSAPTTPARRLLRLPFPPPSPAKHIRAALARRHGPPRPSIPEEGSG

SEQ ID NO: 88086 - DNA, 881 bp, Zea mays
  misc_feature: Ceres CLONE 1575298
  misc_feature: Encodes the peptide sequence at SEQ ID NO. 88087
  misc_feature (359)..(359): n is a, c, t, g, unknown, or other
  misc_feature (365)..(365): n is a, c, t, g, unknown, or other
ggagctccccgcggtggcggccgctctagaactagtggatcccccgggctgcaggaattcgtctcacccctagaaaaaaaaaaactcacagcacaaacgttcctctcctcttccatcgtcgtcctcgctcccggccccgcctgtctagtcccctcttctcgcgtgcaccccctgtactgtacgtgctaggcacacagctagctgcagccacagcagggcacagcaaatggtttccggtgcgggtcatggtgggtacggcggcggcgacgacgggcaggccgtggacttccggggcaacccggcggaacagtcgaggaccggaagctggctggggcgccgggctgatcccctggcacganctggcngaacgtgtgtgcgtgatgggcgtctcgatgaacctggtgacgtacctcgtcggcgagctgcacctctccaactccaagttcggcaaccgtgtggaccaacttcatgggcaagctcaaactgctcgcccttcgtcggggggtttccttgccaaacccaaagtttgggcgcttaccttaacaattggcaatttcccccaaaaattgccccccccggggcgttaaacttttgtaaaagggggaaacaaaaggggcccaaaaattgcttcccaccgggggttcctggaaaacccccggggggccgggcgccccaaaaaaaatttttcccccccccccggggggaaaattgggccctttttattaccggcgcctttaaacaatgtggcccggggggccccccgggctcaaaagagaaaaaattcggggggtggggggggaaaaatttttaaagggggggcccccccgggggaaaagcccccccgggggttttttttttaacaagcttttttttgtgtgggg

SEQ ID NO: 88087 - protein, 113 aa, Zea mays
  misc_feature: Ceres CLONE 1575298
  misc_feature (38)..(38): Xaa is any aa, unknown, or other
MVGTAAATTGRPWTSGATRRNSRGPEAGWGAGLIPWHXLAERVCVMGVSMNLVTYLVGELHLSNSKFGNRVDQLHGQAQTARPSSGGFLAKPKVWALTLTIGNFPQKLPPPGR

SEQ ID NO: 88088 - DNA, 965 bp, Zea mays
  misc_feature: Ceres CLONE 1575308
  misc_feature: Encodes the peptide sequence at SEQ ID NO. 88089
  misc_feature (750)..(750): n is a, c, t, g, unknown, or other
  misc_feature (832)..(832): n is a, c, t, g, unknown, or other
ctggagctccccgcggtggcggccgctctagaactagtggatcccccgggctgcaggaattcgtctcacccctagaaaaaaaaccctttggtctcctgtcctctcttcgtccaccgcgtcgtcgtctccctccctccctccctccctccctccccgcacccaccgttatatacaacccgtcgggactacactgaccaccgcgcctcgaatccatcgctcaactactcgaacccgactcaccggcgcctactcccgcctggcttccgggcccattcgtcgacccgtcgccgggcgaaagcgcgcctctaaggtctccaacctccgcccgctgaagcgacggcgccgcatcggaggaactgtagctgttagtccgcctcttctcggcagcgcggggcggagatccgactggacttgggatcgattccttcccttttctcgattcagagcgctaacagttcctgagggaagcttctggggacatggacatggcattgcccgttgtgaatgccacagcggcggtgctcgcccgtgtctcggctgccttcaatggcccccttgcccgcgcagtcgtctttggggtccatattgatggtcacttggttgtggaagggcttcttattgcagtcatagtgttccagctctccaggaagagctacaaaccaccaaagaagccactcactggaaaagagaatgatgagctatgtgatgagtgggagccagaagcactatgccctcccatcaggagggggnccaaatagatgctccaacattggaaagtgccgctggacacatacgattggtgatgggtaagaaagtgtgaacttgcatcagncaactacctcgggtttatgggcaacgaaagatattgggatctgatcagtcattggagaaaataggggttgggttctgtggcccacgtgcctttaatggaacaatgatgccaatctgactgggagcaaagaagc

SEQ ID NO: 88089 - protein, 92 aa, Zea mays
  misc_feature: Ceres CLONE 1575308
  misc_feature: SWISSPROT Homolog: EC 2.3.1.50 Serine C-palmitoyltransferase
  misc_feature (91)..(91): Xaa is any aa, unknown, or other
MDMALPVVNATAAVLARVSAAFNGPLARAVVFGVHIDGHLVVEGLLIAVIVFQLSRKSYKPPKKPLTGKENDELCDEWEPEALCPPIRRGXK

SEQ ID NO: 88090 - DNA, 939 bp, Zea mays
  misc_feature: Ceres CLONE 1575309
  misc_feature: Encodes the peptide sequence at SEQ ID NO. 88091
  misc_feature (884)..(884): n is a, c, t, g, unknown, or other
ctggagctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcaccctgcacctgatgggggacatccccctacgtgtccctcgccgcgctcgccaccaggtacggcccggacctgatgctgctccgcctcggcgccgtgccgaccgtggtggtctcgtcgccgcgcgtcgccgatgccgtgctccgcacctacgaccacgtcttctcctcccgcccgcgctccctggtgtccgacatcatcatgtacggcgccaccgactcgtgcttcgcgccctacggcgaccacttccgaatgcgctgaagctgtcaccgtgcaccgctaacgccagcagtgcgtccacgcccgaagaaaaaaaaaaattgaggtgccgccctctcaaaggggcccccgccgccccgccgggagccctggaatgagcaatcntgactcctgttaaaactgtttgcggccgtccggaaagttccatgagaaggcccaa

SEQ ID NO: 88091 - protein, 61 aa, Zea mays
  misc_feature: Ceres CLONE 1575309
  misc_feature: SWISSPROT Homolog: EC 1.14.13.68 4-hydroxyphenylacetaldehyde oxime monooxygenase
MLLRLGAVPTVVVSSPRVADAVLRTYDHVFSSRPRSLVSDIIMYGATDSCFAPYGDHFRMR

SEQ ID NO: 88092 - DNA, 977 bp, Zea mays
  misc_feature: Ceres CLONE 1575310
  misc_feature: Encodes the peptide sequence at SEQ ID NO. 88093
  misc_feature (934)..(934): n is a, c, t, g, unknown, or other
aaagctggagctccccgcggtggcggccgctctagaactagtggatcccccgggctgcaggaattcgtctcacccctagaaaaaaaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgacgggggcatcgtgacgatcttcggcggccggctgggacaagtggccaaaggcggagctgaagaaagattacctccgtcggggaagaaagggtaaaactccttccccaaaaagctggcgggggacgctccatttacaaggcgaatccagggccggcgggggcctgaacgggcgtgctgtggcaacatcttgggggggagccttccgggccaggccccagggggggacacacacggcctggctggagnttgccttaattcgggccccggggcgcacaaacgggcgcccccc

SEQ ID NO: 88093 - protein, 215 aa, Zea mays
  misc_feature: Ceres CLONE 1575310
  misc_feature: SWISSPROT Homolog: EC 1.14.13.93 (+)-abscisic acid 8'-hydroxylase
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDGGIVTIFGGRLGQVAKGGAEERLPPSGKKG

SEQ ID NO: 88094 - DNA, 948 bp, Zea mays
  misc_feature: Ceres CLONE 1575313
  misc_feature: Encodes the peptide sequence at SEQ ID NO. 88095
  misc_feature (697)..(697): n is a, c, t, g, unknown, or other
  misc_feature (765)..(765): n is a, c, t, g, unknown, or other
  misc_feature (766)..(766): n is a, c, t, g, unknown, or other
  misc_feature (790)..(790): n is a, c, t, g, unknown, or other
  misc_feature (791)..(791): n is a, c, t, g, unknown, or other
  misc_feature (901)..(901): n is a, c, t, g, unknown, or other
ctggagctccccgcggtggcggccgctctagaactagtggatcccccgggctgcaggaattcgtctcacccctagaaaaatccgactcccacctccagccaaatcgggctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggccccagggcaccaccaacgtcggccgctacagcatggtgggagcccacccagtgatggagattgtggccaaagaccacaaggttacgatcatggaccacgagaagagccaagtgacagagcatgtagtggacgacccgatgcagatcccgaggacatgnatggagggatggcacccacagcagatcgacgagctccctgaatcctctccggtgggaatggggtgggnntcttttcctatgatacggttaggnntatgttgagaagaaagaagctaacgttctccagtgctcctcatgacgtatagaaaccttcctgatgtgcactgggacaccctatgatgatggtctagtcctccgataatnttgaaaaagaaagaaatggtatcccatggggtcaatgtggacccggc

SEQ ID NO: 88095 - protein, 214 aa, Zea mays
  misc_feature: Ceres CLONE 1575313
  misc_feature (91)..(214): Pfam Name: Anth_synt_I_N Pfam Description: Anthranilate synthase component I, N terminal region
  misc_feature: SWISSPROT Homolog: EC 4.1.3.27 Anthranilate synthase
  misc_feature (181)..(181): Xaa is any aa, unknown, or other
  misc_feature (204)..(204): Xaa is any aa, unknown, or other
  misc_feature (213)..(213): Xaa is any aa, unknown, or other
MESLAATSVFAPSRVAVPAARALVRAGTVVPTRRTSSRSGTSGVKCSAAVTPQASPVISRSAAAAKAAEEDKRRFFEAAARGSGKGNLVPMWECIVSDHLTPVLAYRCLVPEDNVDAPSFLFESVEQGPQGTTNVGRYSMVGAHPVMEIVAKDHKVTIMDHEKSQVTEHVVDDPMQIPRTXMEGWHPQQIDELPESSPVGMGWXSFPMIRLGXC

SEQ ID NO: 88096 - DNA, 941 bp, Zea mays
  misc_feature: Ceres CLONE 1575315
  misc_feature: Encodes the peptide sequence at SEQ ID NO. 88097
atagctggagctccccgcggtggcggccgctctagaactagtggatcccccgggctgcaggaattcgtctctcccctagaaaaagcctcgctgcgccggcctcccaatcgatcgaggcggcgcacagctgaggaaaacccctagccgtaaccctcctcaccgcacagcagctcgagtactcgttctcttccgcatcctcctcctcgtcaactccagtcgtcttcagcccttctccacaatcagggccacctcccaccaccacatttcttctcatccaaccgccccgtacgatcacagagaacggggatggcgagcggcggggcggtgaaggatgtgggctcacctgcggagctggatgctgcagtggccggggcgcgagcggtggccgtgcacttctgggagacctggtgccatgcgtccaagcacatggacgaagtcttcgcgcacctagacgtcgacttcccccacgcagccttcctgagggttgaagctgaagaacaacctgaaatatcagaggcatatggagttacagcagttccatattttgttttctgacaggagaggaaaattgtcgacactttggagggagtaaacccagccagcctgggctactaaggtgcaaaagtagctgggcctgctactgttgctgagtctgctgtgcctgcataccttgggagtcgctgctgggcctgctgtacctgaaaccatccaaagatggcacagctaaatgtatcctctgctgctgaaaggccaactctgggcgtactcaagatgctttgaatacccattggagcaggtttgtcatttccatcccgggtttgtaatggtgaggggaacccgaatcaccgaagtgtggttccacccgttagcggtcacattttgaccaaaagggggggaattgggagcttgacaccattcgaatagattgtccgaacggagaa

SEQ ID NO: 88097 - protein, 82 aa, Zea mays
  misc_feature: Ceres CLONE 1575315
  misc_feature: SWISSPROT Homolog: EC 3.5.1.52 Peptide-N(4)-(N-acetyl-beta-glucosaminyl)asparagine amidase
MASGGAVKDVGSPAELDAAVAGARAVAVHFWETWCHASKHMDEVFAHLDVDFPHAAFLRVEAEEQPEISEAYGVTAVPYFVF

SEQ ID NO: 88098 - DNA, 957 bp, Zea mays
  misc_feature: Ceres CLONE 1575317
  misc_feature: Translation starting site: 318
aaagctggagctccccgcggtggcggccgctctagaactagtggatcccccgggctgcaggaattcgtctcacccctagaaaaagtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatccaaagggtgcgagtaacaaaggagctgctgctgcggggaaggagcccgtgttctctgagagctccccagtgatctcggagcctgtacttgttagcgcccacaacaatgagaccgtgcgggaggtggcgaagggtgagaattccagcgtgcaagaagtgccagtgaccgatgtcagtcaagtcttggagaagcagggcagtgtggggtctgatacgtcccatgatgctgagagggtgaaggaagagcgagcgggcgtgaaggcacaagctgccttccgtggttatctggcacgccgagcattccgtgccctgaaaggggatcatagactacaagcattgattcggggtcatcttgtaaggagggcagctgtttcaactctccgtgcaacatgggttgatggtgaaagttcaagggcctggtcctgggaaggaatccttaaacttctggaagcttccatcaagcaaccatggacctttcccaacaaaaccttccgggggctaaacttggttcctggaaaggagaattgtcctctaaagcatttggcccca

SEQ ID NO: 88099 - DNA, 873 bp, Zea mays
  misc_feature: Ceres CLONE 1575318
  misc_feature: Encodes the peptide sequence at SEQ ID NO. 88100
ctccccgcggtggcggccgctctagaactagtggatcccccgggctgcaggaattcgtctcacccctagaaaaaatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctccctcaggagctcatccgctacggcgagttcgcccaggccacctacgacagcttcgactacgaccgcttctccccctactgcgggagctgcaagtacccggcggagaacttctttcacgaactcggcctccggcggatcggctacaaagtcacccggctccttctacccccccggaaaagacccccaagttcccccaatttgggttcaaaaaggccgccaaacgccaaatgggggacgaagtcccggcactttcatggggtgacggggcccgtgtccccgaaaaaggaaacagggcgggttcagccccccgggaaatccccttgggttgggggcggaccctttc

SEQ ID NO: 88100 - protein, 214 aa, Zea mays
  misc_feature: Ceres CLONE 1575318
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLPQELIRYGEFAQATYDSFDYDRFSPYCGSCKYPAENFFHELGLRRIGYKVTRLLLPPRKRPPSSPNLGSKRPPNAKWGTKSRHFHGVTGPVSPKKETGRVQPPGKSPWVGGGPF

SEQ ID NO: 88101 - DNA, 936 bp, Zea mays
  misc_feature: Ceres CLONE 1575319
  misc_feature: Encodes the peptide sequence at SEQ ID NO. 88102
ggagctccccgcggtggcggccgctctagaactagtggatcccccgggctgcaggaattcgtctcacccctagaaaaaagctgttctgcgcaccggacggacagcctgctctgcctctactgaactacttcgccactgcacctcccactccctgcctgcccctctacaaatctctcctgctccactcttctccacgtccatcccgcgccccgaatttcccgagccaactccgccctgccctgtcgctttcccttccacacgcgccgttcgctttgatcgatcaggcaggcatggccgacgagacgaagcaagaagccgccgcccccgcggccgaggtggtcgtgacggaggatgagaagaaggcagaagagaccgccccggtggcggaggaaaaggccgtggaggcggctgtagagaaggccgcggaggcggaggcgggggcggaggaaaaggtcgcggaagcggactcggaggaggagaagatagcggaggaggccgatgaggccgccgcgggggatgaggcggcggtgatcgatggcactgggtcgttcaaggaggagagtaacctggtgtccgagctccccgaccctgagcgcacagcgctcgcgcagctcaaggagctcgtcgccaccgcgctcgcttacggggagttcaacctgtcgccgccgccagccaatgaggaggccaagaatgaggagccggcaaaggaaaaaactccggccgacaaggaggacgagcccaaggaaaagaagcggctgcccaaagcccttcaagaaggaagccaacctgagaagcccaaacgagagcgcccggggaagcaaccccccaagaaggttaaggaataaacaccctgcccgaaaaaacaaaaatggaggccccccgccggagaaacccagggcgaaaaaccggccaaggaagaacccaagggaaaggggg

SEQ ID NO: 88102 - protein, 184 aa, Zea mays
  misc_feature: Ceres CLONE 1575319
MADETKQEAAAPAAEVVVTEDEKKAEETAPVAEEKAVEAAVEKAAEAEAGAEEKVAEADSEEEKIAEEADEAAAGDEAAVIDGTGSFKEESNLVSELPDPERTALAQLKELVATALAYGEFNLSPPPANEEAKNEEPAKEKTPADKEDEPKEKKRLPKALQEGSQPEKPKRERPGKQPPKKVKE

SEQ ID NO: 88103 - DNA, 875 bp, Zea mays
  misc_feature: Ceres CLONE 1575322
  misc_feature: Encodes the peptide sequence at SEQ ID NO. 88104
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (767)..(767): n is a, c, t, g, unknown, or other
  misc_feature (804)..(804): n is a, c, t, g, unknown, or other
  misc_feature (807)..(807): n is a, c, t, g, unknown, or other
  misc_feature (833)..(833): n is a, c, t, g, unknown, or other
nnnnnnnnnnnnnnnnnnnnnnnnnnnnnnnnnnnnnnnnnnnnnnnnnnnnnnnnnnnnnnccccnnnnncccaaactggggctcccgcggtggcggccgctctagaatagtggatcccccgggctgcaggaattcgtctcacccctagaaaaaagtgctcgtcctcgcccagcaccgtaaccaccggacagagcacgcaccatgaaacccaccaccagcagcacgctgctgctggcagcggcggtgctctgcctcgcgctgccgctgctccccggcgccacggccaaggtcgggcgcggggcgccggcaggggcgaactaccctgggcgcgccctggcgccggggtcgtccgcccgtgggccccggcccaaagttcgggcggttcccctggggcgggtccgccgggccaaagggggaaacaaaagggggcccccgggggaaaacggcggggggggttccccccccccgggggggcctttgggggggggccccccccccagggggggggggggggaaaaaaaaacccccccccccctgggggggggaaaaaaaaaaggggggggtgttttttcccccccccccggggggggggaaaacaaaaaaacaacccctttctttttttggtgggggggggggggggggggggtcctttaaaaaaaaaagaaaaaaatttttctctttttttgtttgggagggggagaggaagacattttttttttnncnnnnnnnnccccccccggggcgggggggggggggggggactanaccaccccattttcctttttttatacataaataggcnttnttggtgggtgttggggtaaaaaaaanaaaccccccccccccccccccccctctcctccgcgggggggg

SEQ ID NO: 88104 - protein, 150 aa, Zea mays
  misc_feature: Ceres CLONE 1575322
MKPTTSSTLLLAAAVLCLALPLLPGATAKVGRGAPAGANYPGRALAPGSSARGPRPKVRAVPLGRVRRAKGGNKRGPPGENGGGGSPPPGGPLGGGPPPRGGGGEKKTPPPLGGGKKKGGGVFSPPPGGGENKKTTPFFFWWGGGGGGVL

SEQ ID NO: 88105 - DNA, 961 bp, Zea mays
  misc_feature: Ceres CLONE 1575323
  misc_feature: Translation starting site: 749
  misc_feature: SWISSPROT Homolog: EC 2.7.11.1 Non-specific serine/threonine protein kinase
  misc_feature (459)..(459): n is a, c, t, g, unknown, or other
  misc_feature (748)..(748): n is a, c, t, g, unknown, or other
  misc_feature (861)..(861): n is a, c, t, g, unknown, or other
  misc_feature (898)..(898): n is a, c, t, g, unknown, or other
aagctggagctccccgcggtggcggccgctctagaactagtggatcccccgggctgcaggaattcgtctcacccctagaaaaaagtggcgggttcccacacgggggctagacgccgccaccgctgaccccgtctacaccgaatcccccgcgcgatttaacccctcgcatcgctcgccgcctccgcttccatacaaccgcgcactccaaacgcgcacgcgctgttcgttcctcggccgctctctccaccccctccttctccgcccccaacagatctccgccggccgtgcggttccttaattcgccttctccgggactgtcggatctccgcggcggctgaggatgggcaactgctgcgtgacgccgaaagcagccgacgacgccggcggcggcaagaagcccaaggagctgaagcagaagaagggtaagaagccgaaccccttctcgatcgagtacaaccngttcggggcaggcgagcgcgccaaagctggtggtgctgcgggatcccacggggcgggacatcgcggcgcggtacgagctcggcgcggagctcgggcgcggcgagttcggggttacctacctctgcacagaccgcgcctcaggggaggcgctggcctgcaagtccatctccaagaagaagctccgcaccgccgtcgacctcgaggacgtgcgcgggggaaggtggagatcatgcgccacctcccaagcaccccaacatcgtcacgctcagggacacgtacgaggacgacnatgccgtgcacctcgtcatggagctctggcgagggcggtgagctcttcgaccgcatcgtggcgcggggacactacactgagcggtgctgccgccttggtcttaccactattcnttgaagtcgtgcaaatgtgcccttaagcatggagggnggcccagggatctccaacccaaaaaattccttgtttgcaacaagaaaaatcaccgccctttag

SEQ ID NO: 88106 - DNA, 969 bp, Zea mays
  misc_feature: Ceres CLONE 1575324
  misc_feature: Encodes the peptide sequence at SEQ ID NO. 88107
ctccccgcggtggcggccgctctagaactagtggatcccccgggctgcaggaattcgtctcacccctagaaaaagaacctcgcgtcctcctcgcctgcctgcctacaagtctcccccctcccctcccatcccctccccgtgcctccctcgggcctcgcttctcgcgctcttcctctcttgcctccgcctgcctccaggctccaacaacccgggagggcgccgtccgcccccgcctccgggagcgatgatgatcgcgcgacgcctgctccgacccaatgcccccgcccaggcaagcagcttattgaagcatgtaactggcaccgcaagtttgcaaggctatgcggatagcttgttggatgcgacagtcacacattttggttcagcaccgtctgcccagcctgaagaaaatgggttcaagggccacggcatgctggcgccttttacagctggctggcagagcaatgatttgcaccctctgatcattgagagatctgaggggttcctatgtctatgacatttatgggaaacaagtatccggaactcccctggcaggaatatgggggcacagcctttaggtgggtagccaaccccccgatttattccaaagcaccttccgtgagccattttaaaaaaacatccccttctaacatttcctttgtgggaaacgggacaaaaaaaaccctttggtgtgggaccttggcaagaggaaaacccctaaacggttccccccgcaaggggaaaagggggaaaaatttttttttccaaaaagagggggttccaaaaacaaaaaaccccccggaggaaaaaatggtggggggttataaaaaagggggggggggggggggacacaaaaaaaaaatttttttgcgggacaaaaaaaataagagggggatatcttgggttttgagggagaaataagtggtgttctcccccccacccaagattgtttgctccccacccatttgttgt

SEQ ID NO: 88107 - protein, 89 aa, Zea mays
  misc_feature: Ceres CLONE 1575324
MMIARRLLRPNAPAQASSLLKHVTGTASLQGYADSLLDATVTHFGSAPSAQPEENGFKGHGMLAPFTAGWQSNDLHPLIIERSEGFLCL

SEQ ID NO: 88108 - DNA, 940 bp, Zea mays
  misc_feature: Ceres CLONE 1575325
  misc_feature: Encodes the peptide sequence at SEQ ID NO. 88109
  misc_feature (812)..(812): n is a, c, t, g, unknown, or other
  misc_feature (813)..(813): n is a, c, t, g, unknown, or other
  misc_feature (858)..(858): n is a, c, t, g, unknown, or other
  misc_feature (898)..(898): n is a, c, t, g, unknown, or other
ggagctccccgcggtggcggccgctctagaactagtggatcccccgggctgcaggaattcgtctcacccctagaaaaaaggactgtaggaggagcgacgcatcgcaacgccaacactcacagttgactatcccaccaaggtaacggacacaagcttccctgcagctcgctctcgcattctatctccctcccagtcccagacccagtcccagctgttgcagcctccgaacatccaaagctcctgcactgcacccctgtcagtcaggcctctagctgcagccaaaaaccgctggccttgaacatctccccatccgcctcccgcggcctgccacgcgacatgattgagtcgcgggctgctgcggagctcagctgcccccgcacgccgctggcgacgccttctgcttgcccgcctctgcccgcccgccttccctgatccctcctcccctttgcttccgcacgaagatctgggcgtgtcttcttccgacaaagctgttcaggcaggggagagtgcctgtttcgagggggcgtggagcggagccggagccatggggaagaagggcaagtggttcggcgccgtcaagaaggtcttcagccctgaatccaaggagaagaaagaggagaggctaaggaggaagtcagcaggtagcaacccgacgccggtagatctgaccccgtctacctccttggaagtcaatctttcggtggcaccgcctccagctcctcccccagttcttcacatgtccgaggaaggttggggtccctgaagccgagcatgagcagagctagcatgtctgccgtggaggatgcccctgnnctgcgcccagcgcatgcgtcggtgctgccacctgctgtgccaccnatgagctcgccgcagtcaagatcagaaccgcctccgaggntacctgggcaggaggcactactacactgctaggctgtgtcga

SEQ ID NO: 88109 - protein, 72 aa, Zea mays
  misc_feature: Ceres CLONE 1575325
MGKKGKWFGAVKKVFSPESKEKKEERLRRKSAGSNPTPVDLTPSTSLEVNLSVAPPPAPPPVLHMSEEGWGP

SEQ ID NO: 88110 - DNA, 981 bp, Zea mays
  misc_feature: Ceres CLONE 1575326
  misc_feature: Translation starting site: 198
  misc_feature: Pfam Name: Glutenin_hmw Pfam Description: High molecular weight glutenin subunit
  misc_feature (565)..(565): n is a, c, t, g, unknown, or other
  misc_feature (981)..(981): n is a, c, t, g, unknown, or other
agctccccgcggtggcggccgctctagaactagtggatcccccgggctgcaggaattcgtctcacccctagaaaaaattcgagttcgaggcgacaggcatcgtcgtcccacccagcagtgcagagactctctctccctccctctccccggccacctctcgctcacgagcaccccatcttcccggccagggcctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctcctcctggcgctccgctcgctcaccttccagctctggttctcctacggcaacatgctcttcttcacccgccgccgccgcgtcgtcaaagacggcgtcgacttccgccagatcgacgccgagtgggactgggataacatggtgatcctgcaaaccctggtcgcggcggtggcgatgggcagcgcgggcttcccggccgtgtcggaactgcgggcgtgggaccnccgcgggtgggccctggccttgctcctgcacgtggccgtctcggagcccgcctttcttctggggccacaggggcgctgcaccgggggcccgctctttaggccatgtccaccgccagggaaccattccttcccccgtcacagcagccgtttcacgggccggtttcgggaaccccccttggaggccctgctccctgaacccttgggaaggggggccccccctggcgggaggcctttcttggcggggccctgggtcccttaaacctggtttatggggccatttctcctcctccaagggctcccgggggattggggtaaaccaacccggaaagtattctctcaaaaggggcctttgcccccctttcccgcgggttaaaataacgtgcttaacccgcccacttttttagaccctcgcccan

SEQ ID NO: 88111 - DNA, 1064 bp, Zea mays
  misc_feature: Ceres CLONE 1575327
  misc_feature (368)..(368): n is a, c, t, g, unknown, or other
  misc_feature (1064)..(1064): n is a, c, t, g, unknown, or other
ctccccgcggtggcggccgctctagaactagtggatcccccgggctgcaggaattcgtctcacccctagaaaaatctccgctctgctccctccgccgtgcgctcgaacgaactccacacgaaattctccgcgtaaagttggggagcagcgaacccgtagcgcgcgccccggatccctccacgggggggcatggcctcgtcggcgttcctgccccatctgggcacccagggggtggggtgcccgttgcggccgtggtaaggataacattcgcggtgctgcaatgggggggtgggctccaaagtgaaattcttcccccaggcgcgccgcggcgaaaggctcccccggggaaaaggggccccccccccgcnccaaccaatacctctttgtgggaggggggagggggtcaaaaaaacaaaaactccgccttcaaatgggcgccaaattccgaaaaccccccctcccaaaggaggaaaatttttttcccttttctcccgaatacaaaatatggtggggaatatatttttggggcatccttttgctgggtccggaaatctccccccttcccttgggttttcttttgaaaaggcttcccctacccccgatagttaggtttgtgttccacctatcctcaatagggaggaaaaaaccgagaaaatggtttcccccccttggccgagtggataacccttttaagcgaccaactcggactttttttgtgcttttgaggggcaacatacacccccccgtttggtttccgtgagggtccccccgccaacagaaaaattgtaccccccttttgcacccaaccccggggaaaaaacctttcaaaattactataagagggcggttttaaaataacacaatctataaaagggtattctccttccgcggcgcctgcgtgaggggttgcccctctctcccggtaaaagagaacatttcgctactctgtagtgcaatttaacacacctgggtgaacaattagtgggagaggacctgggaggcacctttatacaaacctccgtgattatatcttgcgggcgcctcctgcgtgtctcctggtcggn

SEQ ID NO: 88112 - DNA, 877 bp, Zea mays
  misc_feature: Ceres CLONE 1575330
  misc_feature: Encodes the peptide sequence at SEQ ID NO. 88113
ctccccgcggtggcggccgctctagaactagtggatcccccgggctgcaggaattcgtctcacccctagaaaaactcctcttctatttgttcgtttacagcccccagctcatcaaagatcacattttgagcaccgctatataaacaaagttggcaggagtcgtagattagcaggccgcccgtctatttttttgttcatgttttgaaagtgaaggaggatttgggtgggcaacgtctacctctgccaaaaataatcggcgtccatatgcaggcgtcgtatctttggaataagtgaatagcaggcagatggcaggcggcggattcgtggaggacatgatgagggagcagagcctcctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgcgccggcaatgcgctcgtcccgcctgctgcccccgcgcagcacgacgcttccgctagcgccttcttcgccgccgcggggaacgatgtgttcgacaccaaggacgtcgtcggcgcacacatcggctcgtgcgacgacattgacatggacatggcgcagctggagtggctgtcggggctcttcgacgacgcctcatcccgcacgagccggtgttccctggcgcgacggctggctgcgcggcgcccatcatgaagagctccgcgctggcggccggcgcgctgctgccgcagtacaaatggatgacgcgctgctgttccgcagctccagccccatctcggtgctggaccaccgcatgcgtggcatgcgcagcgcagcgccacggt

SEQ ID NO: 88113 - protein, 146 aa, Zea mays
  misc_feature: Ceres CLONE 1575330
MAGGGFVEDMMREQSLLEATCGDLFDHIDDLLDFPNEDSAAAVLLLDAPAPGSPLSARIIDVGRAGNALVPPAAPAQHDASASAFFAAAGNDVFDTKDVVGAHIGSCDDIDMDMAQLEWLSGLFDDASSRTSRCSLARRLAARRPS

SEQ ID NO: 88114 - DNA, 1114 bp, Zea mays
  misc_feature: Ceres CLONE 1575332
ctggagctcaccgcggtggcggccgctctagaactagtggatcccccgggctgcaggaattcgtatcagacctagaaaaaacaaaagctaggtgatcagcgatgaccaggcgtaagaaagctagcgagcaagtcactgagtagctagcatagataccaccatagaaacacctcacacgcacttgcgctaataagctaagcttaacgtaactcctctctatctccggctatctcatatggacgaagctgccttggctgcgcaactgcatcacgaaatgttccagctgctgcatcaaactgcagcaacgtatcaagcgctgctggtatcgatccacttctccctgcagctcctgcagctcctgcttggctaactcgagtggtctgagtcagcttgagcaactgcgacaaacaaccacgaaacggcggtagtggcagccaaaatacaccgacaagctctttgagcctgacagccaatctccgctcattaaaaatccccattcttctgggaaccttgcaccctgatggggggaaattccccctaggtttttcacaaagcccgcgtttttaccataagggttagggcccgaaaaaaagtatcctcgcttaaaagattccgggggcgggaaaaaaaaccaggggtgggacacatttttcccgaggaaattacatataggtcccgtgggttccccaaaactttttaaaaaaaggtgtttttataccttcccagaacgcggaagctccccctggggatggctccaaaacatttctttatgtgtaaggggggggacaaaattacctctggggtgttttggggactttagagcggataaaccattctgtggaaagaggtgcaccaaatattgtgtcccactcttgacacatgtcataaaaacacccaaaataatggtattgtctagcggcgccccaccgcggattataaaaaggtgagtataacggtcctccctcataaataaatatctctcccctgtgacggcaaaaaaaagacccctggatgtagggtactaattttccgcgcgggcgggaaaaaatctcttctttgagagaaaatactgtgtggtgattcttcaaataagaaaagaatctaaatatttata

SEQ ID NO: 88115 - DNA, 967 bp, Zea mays
  misc_feature: Ceres CLONE 1575333
  misc_feature: Encodes the peptide sequence at SEQ ID NO. 88116
  misc_feature (475)..(475): n is a, c, t, g, unknown, or other
  misc_feature (559)..(559): n is a, c, t, g, unknown, or other
ctggagctccccgcggtggcggccgctctagaactagtggatcccccgggctgcaggaattcgtctcacccctagaaaaagttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcangaaagatttatgaatggagatgggttcaactacatcaaagaatcttttgaaaatggtactcttcaccttattgggttgttgagntgatggtggtgtccactcccgccttgaccaactacagttacttctgaaaggtgtcagtgagagaagagcaaaaaaaattcgtgtgcacatccctaccgatggggcgtgacgttttggatggaagcagtggttggtttcgtggagaccctagagaatgatcttttggagcttcgaggcaagggtattgatgtacagattgcatctggtggtggggaaggatgtatgttaccatggaccgttatgagaatgactgggattgtggttaaacgtggctggggatgctcaagtgcctcgagaagcaccctacaaattcaaaagtgcattggaggccgtgaaaaccctgaaacccagcccaagcttatgatcatacctgcccccatttgggatagtgatgacaccgcaaactgt

SEQ ID NO: 88116 - protein, 120 aa, Zea mays
  misc_feature: Ceres CLONE 1575333
  misc_feature (15)..(121): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (105)..(105): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASXKIYEWRWVQLHQRIF

SEQ ID NO: 88117 - DNA, 987 bp, Zea mays
  misc_feature: Ceres CLONE 1575334
aaagctgtagctcaccgcggtggcggccgctctagaactagtggatcccccgggctgcaggaattcgccccacccctttaaaaacaactcgatggtcggataggggcctaccttggtggtgacgggtgacggacaattagggttcgattccggagaggatcccctcccgacgaatggagtctccgtcaccacctcgcctgctagcctcctccgtctgctcaagacgagggaggagcagagaccgaactctgccgtgtcttcctcctccctctgcacccccacgagctccatggccgccaccgccatgattgggattaccaacctacgttgccgccacgacccgctctcctcccttccccgggctacgtggtcggtcgcccggtgctgtaccctgcttccccccccacgccgccgccattcttcttgctgctccccttcctcctccgtctctccgtgccgggcccgggtccgaccaacagcagcactgaagcgcattcctgcccgcgacaccggcttcatgggtccagccaacaatggaggccaccacgcttaaacgatcatcggcgggctgacctttgccgccgccttattgtccccagctccaccgcttggctccggacacccctgccaggggcttccacaggaaggctcccccgcccattatcggggggttggcccattctgctcgagtttcctggggtcattcttcctccccatgggacagagtccttcatgcaggcttttcttcgccccgtgtcaaacaatttcccgaaggtgcccttttcgaggaaggctcgaggtccttctcgggggactgttaggtttttaaacacatccaggcctcctcccatgcaaaatgggttttcttgggcgttcttttaattccggccagcctgtttccatccaagggaggggcggtcccgttgttttatcgatccacgcctattggtcctgcttaggcctctgccgcctgtgggggtatttccc

SEQ ID NO: 88118 - DNA, 880 bp, Zea mays
  misc_feature: Ceres CLONE 1575336
  misc_feature: Translation starting site: 120
  misc_feature (276)..(276): n is a, c, t, g, unknown, or other
  misc_feature (277)..(277): n is a, c, t, g, unknown, or other
ctggagctccccgcggtggcggccgctctagaactagtggatcccccgggctgcaggaattcgtctcacccctagaaaaaacattcccatcggcgcagacggccgggaggaggatgtccatgccggagacgttcaccctgaaggtgggggaggcgacgccggccgccgccggcaggccgtcggccgggcccgtgtaccggagcatctacgccaaggacggcctcatggacctcccacaggacatccagtccccttgggacttgttcagtggggcanngtcaagaagtaccccacgaacaggatggtcgggcagcgtcaggttacagatggcaaggccggtgagtatgtgtggcaaacgtacgaggaagtgtgccagaaggtcatgaggattggatcagcgatcagaagcctgggcgtagagccgggagctcactgtggcatatatggatccaactgccccggaatgggttatggccatgcaggcatgtaacagtcaagggatatgttatgtgccactgtatgacaccctcggagctaaagctgttgattcatcatgtacatgctgaaattcctttgcctttgcccggagagcagatcaatccatacttggcgttctccccaaagggaagggcaactttaaacccttggtatttttcgaaaattttcccacccaattaaaaccgaaacccgaaaaatggggcccccccgctttttttggggaaaaaattttctccccgggggaaaaaaaaaccccccccctctcccaaaaaaaggggggaaaatttttggcacacccggggtttcccgcggagaaacacggggtgtctcccccgggggggggtttttctccccaaaaatttcttttcttttttgggttgtt

SEQ ID NO: 88119 - DNA, 1109 bp, Zea mays
  misc_feature: Ceres CLONE 1575339
aaagctggagctccccgcggtggcggccgctctagaactagtggatcccccgggctgcaggaattcgtctcacccctagaaaaaacagcggcggcgggccaggccagcagagcgcaaaagaccgccgctcggaaagtgcggagccatttcccctctagctgctctctgcttgactcaatccactcacagtcactgcccacgtccacgcctcgagctctctacaggctccctggtgctcccatatcaatcgcttccgctgctagcagcgcgcgctatccccgatgccgcgcgcttgatgcgcgctcaacgccatgtcatacgccgagggcgggtatggaggcggcggcggcacgtgaagcggcgccgagccccacgggcacgccgacttcctggtgcatcaacatgcacagcacgtcagccgagcaaaaagctgtacgaaaaggccccagaacatgccgcacgcgagaaagttgctgtttcccccaaagacgtaccccccccccaaaagacctcggggttgccgtccaaacagcaagcacaggcggggaaggggggggcctgggcccaccccccttccgggggtttaaacttggaaagcggtaactcttcccaaagggggaaattaatttccccaaaattagccccccactttttggggaaaagggcccccattctccggtggggggggggcaaaggggatcctgaacacagagcggggctaaaaggttccgatgtatccccgagagcgaaaaaaatatttgatggttttcgggagctcaggtaacccgtgttcctctaaaaaaagctggggatcccccgtcccccggggaaatcgaaaagagaggggtttagggcccccggcgccctataagggcccctttctccggggataaacgagaatattgtttgagagccacctccggtttccccccacccccccccaataaaaagggtgctcaagaaaaatcttcccattaggggggggtgggccgcccacggggggaaaacagtgtccccccaaaagagggccccctcccctctctctccgggggattacttatctacaaaaggaagagcggccgctagggtctctcccatggtggggataa

SEQ ID NO: 88120 - DNA, 977 bp, Zea mays
  misc_feature: Ceres CLONE 1575340
  misc_feature: Encodes the peptide sequence at SEQ ID NO. 88121
  misc_feature (711)..(711): n is a, c, t, g, unknown, or other
tggagctccccgcggtggcggccgctctagaactagtggatcccccgggctgcaggaattcgtctcacccctagaaaaaacagactcctcacacttagtactgttagccaggaacaagccccagcagcagcagcagcaatggccgtggagaacggcagcgcctacgaggcggcggcggtgaccgtgaccgtgaccggcgcccgcaccgtggcgccggccaagaaccgctgcacgctcgccaccttcgacctcccctacatcaccttctactacaaccagaagctgctcctgtagcgagccgcccccgacttctcggacgccgtggcgcgcatgacggccgcgctcgccgacgcgctacgcgtcttctatccgctcgcctggcgcatacgcctggaccaccgcggcgcgctggctgtcgagggccaacaaggcgccaaagtcttcgaaggcgaatgccaggggggtctccgtttacgacctccccggatgggactgccgcgacgaaggtggaaaaggtcttgcagcacctcctggccttcaccggggtctttaaccttggtgggcctccgacttccggtttctcccccttcaaaggaagtgcccgttgaattggtcgaattttccgaaatcttttcgtggcccacctatggtgttctcaggggggcaattcgtgattaattttggaacccccccattcccctttaattttcnatttggggtgacccccttgttccaaaactgtgaggtgaaaatccctttaaattcttcaggatgggcatggttaaaccccccaacaaggaaaaacttttaaaatactaagaattttttttttaaaaaagcaaattttccaatatgaagaagtggcctcctgaatatgggtccctttcaaactttcctccccggcatatagaccttttatagtcaaccaaccccccgttattttgagaatagaaaatttggccttttgggaccaattc

SEQ ID NO: 88121 - protein, 51 aa, Zea mays
  misc_feature: Ceres CLONE 1575340
MAVENGSAYEAAAVTVTVTGARTVAPAKNRCTLATFDLPYITFYYNQKLLL

SEQ ID NO: 88122 - DNA, 943 bp, Zea mays
  misc_feature: Ceres CLONE 1575341
  misc_feature: Translation starting site: 281
  misc_feature (798)..(798): n is a, c, t, g, unknown, or other
  misc_feature (830)..(830): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaaaaagcagcgcctcgccctcgtcctcctcctccagtccggatcgccatttcccaccgatccgtcccggcatcggcatggctgcgcccacgccaaaggcgccggcgcccagtgcttcggcagcctagcgtttgtttgcctccgaggatttccgcctatcgcgttaccggatcttcggtgggccggcgaccctctacgccactatgagctccgacgggcgcctccgccgcgcgctggccgcgttcggcggcgacgtgtgggacctcgtggacgcggcgctcgccgccgccgcgcgggacagccccggcgacctgcgcgcgcgccgcgacggcatcgtccagcgcctctacgcaggggcagcccgctgccgcaactgcgacgccgacgcaaccccggcgcctgctcagccgaggaaggccaatgacgccgtcgctgctgctgctgctgcttctcctgcggcggcggcggcgtcggcgtttccggcctcgcctgaacaggaggtcgacgcggacggcctcgacgacgtcgacgacgcggccgacgctggcatggagagcaagattctggcgatcagggatttcctggaggacccggaccaggtcctcaaatatcccatctataccgcttttgattgacactttgacagtgctacaatttgccgacaaaaaagtagataaggagctcactgcttcgatgcatatgcaccctctgtcttgtggtnctctcacagtctgaagacgacatagtgagccntactcagaaactagcagacatggatatcacctacaaggctctccangacacggatatcgggccgccatgttgatggcctgccgtagcaccccatcagcgagggtccggcaacg

SEQ ID NO: 88123 - DNA, 917 bp, Zea mays
  misc_feature: Ceres CLONE 1575342
  misc_feature: Encodes the peptide sequence at SEQ ID NO. 88124
  misc_feature (628)..(628): n is a, c, t, g, unknown, or other
  misc_feature (773)..(773): n is a, c, t, g, unknown, or other
  misc_feature (846)..(846): n is a, c, t, g, unknown, or other
  misc_feature (889)..(889): n is a, c, t, g, unknown, or other
tggagctccccgcggtggcggccgctctagaatagtggatcccccgggctgcaggaattcgtctcacccctagaaaaaaagcccatggtgtccttccccgtgctgtccagcccgctcgctggggcgcgtccgtcgccgctggacatcgacagcggtggcgtactggggggtgctgccacttatggcggcgccgctgacatcttcggcggcggcggcggcgtcgctgcttgtggtgcggccagggattgtgacaagcctatgattgtggagctggctgtgacggccatggaggagctggttcggatggcgcagctggacgagccgctgtggaacgcgccggcaggcgggcacgacgggtctgctgagacgctgaacgaggaggagtacgcgcgcatgttcgtccctgctggagggctcgggctaaaaaagcagtacgggttcaagtcggaggcgtcgcgcgacagctccgtcgtcatcatgacccatgccagcctcgtcgagatcctcatggacgtgaatcagtatgcgacggtgttctcgagcatcgtgtcgagagctgcgacgctggaggtgctgtccaccggcgtggctgggaactacaatggcgcattgcaagtgatgtcggttngagtttcaggtgccttccccactggtgccgactagggatagctattttcgtgaggtactgcaagcagaaacgcgatggaacatgggcccgtcgtcgacgtctcgctggacacagctcagtcctcaagtgccggcgcgggccgtcnggatgcctgatccaggaatgcccatggctactcaaagtgaccgggtgggacacgtcgaggtggatgacagtcngtaacggcatctacaaactgctggtggatcagggctcgcctcngggcacgccgatgggtcggaaccctgac

SEQ ID NO: 88124 - protein, 192 aa, Zea mays
  misc_feature: Ceres CLONE 1575342
  misc_feature (182)..(182): Xaa is any aa, unknown, or other
MVSFPVLSSPLAGARPSPLDIDSGGVLGGAATYGGAADIFGGGGGVAACGAARDCDKPMIVELAVTAMEELVRMAQLDEPLWNAPAGGHDGSAETLNEEEYARMFVPAGGLGLKKQYGFKSEASRDSSVVIMTHASLVEILMDVNQYATVFSSIVSRAATLEVLSTGVAGNYNGALQVMSVXVSGAFPTGAD

SEQ ID NO: 88125 - DNA, 866 bp, Zea mays
  misc_feature: Ceres CLONE 1575343
  misc_feature: Encodes the peptide sequence at SEQ ID NO. 88126
  misc_feature (276)..(276): n is a, c, t, g, unknown, or other
  misc_feature (600)..(600): n is a, c, t, g, unknown, or other
  misc_feature (657)..(657): n is a, c, t, g, unknown, or other
ctggagctccccgcggtggcggccgctctagaactagtggatcccccgggctgcaggaattcgtctcacccctagaaaaaactccttccttcccgcgactgggggcgactggctcgttgcctccccgtcctcgcacccacccacggacccacctctttattcaccccgacgcccctcctccgttcgctttccccctcctcgcctcgggggtgcgtgaatttcgactagggtttcgcggaccgagagggaggggagaggagagggcgggtagggttntccgcggacgggccccgcatggcctcggcggcggcggcgccggccgcgggggagaagaagggcgcgggcgggccggtcacgggggacatggtcagcgcgggcttcgcggagctggagcggcagcagcggctgctcgccacctgcacgcgcctctaccagcacctgtctgaccacttcggctcgctcgagcgcgggctcgccgcgcgctccgacgcgctccgcgtccgccgcatggcattcgacgcgcgcacccaccgcgcgctcgactcgctccactgcgcgagtctccatcgacgcctccgtctcgcgcgcgctcggacaacntcaattcattctcggcaaggggtcaccgccggctcggatccggaaaccccgccgggnccggccggccaatggctggcccgccctttgcggccgggatgggctccaccggttcccgggggtttctgggtggcccccccaaagaaggggaaacccctcgggggggaaataccggggggcccaaaactttggggggatcccgcccaatttttttggggaacccgtcccaaaattttccccctgtaaaacgccggggggggcgggaaccc

SEQ ID NO: 88126 - protein, 182 aa, Zea mays
  misc_feature: Ceres CLONE 1575343
MASAAAAPAAGEKKGAGGPVTGDMVSAGFAELERQQRLLATCTRLYQHLSDHFGSLERGLAARSDALRVRRMAFDARTHRALDSLHCASLHRRLRLARARTTSIHSRQGVTAGSDPETPPGPAGQWLARPLRPGWAPPVPGGFWVAPPKKGKPLGGEIPGGPKLWGDPAQFFWGTRPKIFPL

SEQ ID NO: 88127 - DNA, 948 bp, Zea mays
  misc_feature: Ceres CLONE 1575344
  misc_feature: Encodes the peptide sequence at SEQ ID NO. 88128
  misc_feature (878)..(878): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaaaacccctgccgcgctagctgtctctccaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgactacctgatcgggacgctgacggtgcgcgagacgatcggctactcggcgctgctgcggctgccggactagatgccgcgggaagacagcgcgcgctggtggagggcacatcgtcgagatgggctgcaggactgcgccacaccgtatcggcactggcnacctccgcgggtcagncgcgcgaagaacgcgcgtcacatcgggctcgactatcatgcgcccgcgctcccc

SEQ ID NO: 88128 - protein, 181 aa, Zea mays
  misc_feature: Ceres CLONE 1575344
  misc_feature: SWISSPROT Homolog: EC 3.6.3.25 Sulfate-transporting ATPase
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNGRKAKLSFGAAAYVTQDDYLIGTLTVRETIGYSALLRLPD

SEQ ID NO: 88129 - DNA, 917 bp, Zea mays
  misc_feature: Ceres CLONE 1575354
  misc_feature: Translation starting site: 256
  misc_feature: Pfam Name: PPP5 Pfam Description: PPP5
  misc_feature: SWISSPROT Homolog: EC 3.1.3.16 Phosphoprotein phosphatase
  misc_feature (680)..(680): n is a, c, t, g, unknown, or other
  misc_feature (765)..(765): n is a, c, t, g, unknown, or other
  misc_feature (784)..(784): n is a, c, t, g, unknown, or other
  misc_feature (802)..(802): n is a, c, t, g, unknown, or other
  misc_feature (803)..(803): n is a, c, t, g, unknown, or other
  misc_feature (816)..(816): n is a, c, t, g, unknown, or other
  misc_feature (822)..(822): n is a, c, t, g, unknown, or other
  misc_feature (825)..(825): n is a, c, t, g, unknown, or other
ctccccgcggtggcggccgctctagaactagtggatcccccgggctgcaggaattcgtctcacccctagaaaaaaccagcgtggtagagtctgctcaacaccaaacttcgacgactgcgccggccgtcggccgtcgctgccgccctattttgaccccatcgccggcgacgataatcgccagtttgtggataagggtcttttaagtcttcatatgaaactatccttttgatatacagctgaaggacaataactatcatggatgctactgcaaattcagatgtgcaaagggctgaggaatttaaacttaaggcgaatgatgccttcaaggcaaacaagttctcgcaggctatagagctttacagtcaagccattaagctgaatagttcaaatgcagtttactgggcaaaccgtgcatttgcacacacaaaattagaggaatacggaagtgctgtgcaggatgctacaaaagccatcgaaattgattctagatattcaaaaggttattatagacgaggcgcagcttatcttgccatgggaaagttcaaggaagccctgaaggattttcagcaggttaaaaaaatctgcccaaatgatccagatgctacaagaaagttgaaagagtgcgagaaagctgtccaaaagatccgttttgaagaagcatatctgctggggatgatgangagcggtccgtggcagactctattgactaccatatcatagaagtagagcacattatgcgggaccgagaattgatggggagaaatnacgatagagttggtcaaangcatgttggatgaatttnnagagcagaatgcntacatnaanatatgcttaccagatgtgctaaaacctggggattgctgcatcgatgcctcccttggttgatgggatgtccaaaacgtggaattttacagttt

SEQ ID NO: 88130 - DNA, 950 bp, Zea mays
  misc_feature: Ceres CLONE 1575356
  misc_feature: Encodes the peptide sequence at SEQ ID NO. 88131
  misc_feature (775)..(775): n is a, c, t, g, unknown, or other
  misc_feature (806)..(806): n is a, c, t, g, unknown, or other
  misc_feature (875)..(875): n is a, c, t, g, unknown, or other
  misc_feature (897)..(897): n is a, c, t, g, unknown, or other
  misc_feature (898)..(898): n is a, c, t, g, unknown, or other
  misc_feature (903)..(903): n is a, c, t, g, unknown, or other
  misc_feature (931)..(931): n is a, c, t, g, unknown, or other
tggagctccccgcggtggcggccgctctagaactagtggatcccccgggctgcaggaattcgtctcacccctagaaaaaaggagatcagagccccggcgaggtcgcaccgcaccagccatcgtctccttccttccttcctatactaccatccaaccagctgcccagcgcaaggttacctgcccgacatccgacaagccagtccatccggctgcgagcaaaggtctgagatgggttccgtagacgcggcgatcgcggtgccagtgccggcggcggaggagaaggcggtggaggagaaggcggtggtgttccgttccaagctccccgacatcgagatcgacagcagcatggcactgcacacctactgcttcgggaagatgggcgaggtggcggagcgggcgtgcctggatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgccgcccgcctgggcgccgccaccaccacggccaacccgttctacaccccgcacgaggtgcaccgccaggcggatgctgccggcgccaggctcatcgtgaccgaggcctgcgccgtggagaaagtgcgggagttcgcggcggagcggggcatccccgtggtcaccgtcgactgtcgcttcgacggctgcgtgggagtcgccgagctgatcgcngccgaagagctggatgccgactcctacatcnaccccgagacgtcgtcgcgctgccctactcctcagggcacacgggctgccaatggcgtcatgctcaccnacgcagcctcatcacaacgtcnngcatnaagttgatggcaaaacccgaccgtactnccgcaggacgaagtggtgg

SEQ ID NO: 88131 - protein, 140 aa, Zea mays
  misc_feature: Ceres CLONE 1575356
  misc_feature: SWISSPROT Homolog: EC 6.2.1.12 4-coumarate--CoA ligase
  misc_feature (107)..(107): Xaa is any aa, unknown, or other
  misc_feature (130)..(130): Xaa is any aa, unknown, or other
  misc_feature (137)..(137): Xaa is any aa, unknown, or other
  misc_feature (139)..(139): Xaa is any aa, unknown, or other
MGVGKGDVVMSLLRNCPEFAFTFLGAARLGAATTTANPFYTPHEVHRQADAAGARLIVTEACAVEKVREFAAERGIPVVTVDCRFDGCVGVAELIAAEELDADSYIXPETSSRCPTPQGTRAANGVMLTXAASSQRXAXS

SEQ ID NO: 88132 - DNA, 958 bp, Zea mays
  misc_feature: Ceres CLONE 1575358
  misc_feature: Encodes the peptide sequence at SEQ ID NO. 88133
  misc_feature (850)..(850): n is a, c, t, g, unknown, or other
  misc_feature (886)..(886): n is a, c, t, g, unknown, or other
tagctggagctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaaggtcaccgcgcggcgatgctggtgcgcatcaacaccctcctccagggctactccggcatccgcttcgagatcctcgaggccatcacgaagctgctcaacaccggtgtcagcccctgcctgccgctccggggcacccatcacgcgtcgggcgacctggtcccgctctcctacatcgccggcctcatcacgggccgcccaacgcgcaagccgtcaccgtcaaacgaaagaaagttgacccccccntaagccttcaaaatcggcggcatcgagggcggcttnctcaggctcaacccaagggagggcctcccatcgtcaacggaacgtctgttgggctccgcgcctcgaggccac

SEQ ID NO: 88133 - protein, 222 aa, Zea mays
  misc_feature: Ceres CLONE 1575358
  misc_feature (41)..(223): Pfam Name: PAL Pfam Description: Phenylalanine and histidine ammonia-lyase
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEGHRAAMLVRINTLLQGYSGIRFEILEAITKLLNTGVSPCLPLRGTHHASGDLVPLSYIAGLITGRPTRKPSPSNERKLTPP

SEQ ID NO: 88134 - DNA, 941 bp, Zea mays
  misc_feature: Ceres CLONE 1575359
  misc_feature: Translation starting site: 193
  misc_feature: SWISSPROT Homolog: EC 1.4.1.2 Glutamate dehydrogenase
  misc_feature (759)..(759): n is a, c, t, g, unknown, or other
  misc_feature (778)..(778): n is a, c, t, g, unknown, or other
  misc_feature (872)..(872): n is a, c, t, g, unknown, or other
ctggagctccccgcggtggcggccgctctagaactagtggatcccccgggctgcaggaattcgtctcacccctagaaaaacattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttggttccaccatcaagaacgcagtggtgacagtgccggcctacttcaacgactcgcagaggcaggccacaaggacgccggtgtcattgcgggcctcaatgtgatgcgtatcatcaacgagcccactgctgctgctattgcctacggtcttgacnagaggccaccagctcgggncgagaagacgtgctcatcttcgaccttggtggtggcacgtttgatgtgtcgctcctcacatcgaggagggcatcctcgaggtgaaggcactgcnggcgaccctcccttgggcggcaagactcgaacatcgcagggggaccacctcgtccaagagtcagcgcaa

SEQ ID NO: 88135 - DNA, 926 bp, Zea mays
  misc_feature: Ceres CLONE 1575362
  misc_feature: Translation starting site: 323
  misc_feature: SWISSPROT Homolog: EC 1.1.1.86 Ketol-acid reductoisomerase
  misc_feature (750)..(750): n is a, c, t, g, unknown, or other
ctggagctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtggggagggatctgttcccgctgttaccggaggccttcaagggaatcaaacagatcggtgtaatcggctggggctcgcagggtcctgcgcaagctcagaacttgagagactcacttgttgaggcaaagtcagatattgttgttaagattggtctccggaaaggttctaaatcttttgaagaagcccgagcagcatgattcaccgaagagagtgggacgctgggtgatatatgggagactgtatcaaaaagtgatcttggtttgctaccgatatctgattctgctcaggctgataactacgagaaaattttctcgcacatgaaaccaaacagtttccttgggttgnacaagggaattctccttggaaaattgcaaaccccgggggtttgtttccccaaaaacatcagtgggaattgctgtatgccccaaggaaatggccccctccccaaaaaaatttggtgtcgggcaaaaaaaaacagggggcgggtaacaaggaaactttgggtgccccaagtttttgaa

SEQ ID NO: 88136 - DNA, 934 bp, Zea mays
  misc_feature: Ceres CLONE 1575365
  misc_feature: Encodes the peptide sequence at SEQ ID NO. 88137
  misc_feature (366)..(366): n is a, c, t, g, unknown, or other
  misc_feature (368)..(368): n is a, c, t, g, unknown, or other
  misc_feature (460)..(460): n is a, c, t, g, unknown, or other
  misc_feature (474)..(474): n is a, c, t, g, unknown, or other
  misc_feature (475)..(475): n is a, c, t, g, unknown, or other
  misc_feature (519)..(519): n is a, c, t, g, unknown, or other
  misc_feature (520)..(520): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (611)..(611): n is a, c, t, g, unknown, or other
  misc_feature (647)..(647): n is a, c, t, g, unknown, or other
  misc_feature (669)..(669): n is a, c, t, g, unknown, or other
  misc_feature (679)..(679): n is a, c, t, g, unknown, or other
  misc_feature (683)..(683): n is a, c, t, g, unknown, or other
  misc_feature (720)..(720): n is a, c, t, g, unknown, or other
  misc_feature (726)..(726): n is a, c, t, g, unknown, or other
  misc_feature (730)..(730): n is a, c, t, g, unknown, or other
  misc_feature (905)..(905): n is a, c, t, g, unknown, or other
aaagctggagctccccgcggtggcggccgctctagaactagtggatcccccgggctgcaggaattctttttttccctttttaaagccccctcccgctcactcgaagaccccgaactcctctgggctcttgtcctccctccctctccagccgccgccgccgccgccgccgccgcccagagccgagcatgccgggtgccttccactccctcctccttccccctcaacggaagcgcaaatccaaacgccgcagcagacacggtcaccgaaaggagaacaacccccacatatcctagaaccacctcgccgccgctggagacccgtccttccacctgaaaagctgcacctctgtctcccccagagatatcnanacccccaccccaccaccttcggggagcgtcttttctctccgccacccccgcgagctaaccttcccgggaaacgggggtgccggggcggctcncgggcctctttccnnaaaaactgggttcctccaacattccttgggaccccctctctcgnnttcgcggnnnaccgctcgcgggcgcttctcgctggcgtccaagggcgctctacgttcgtcgcctccccacgtacccgctctgaggaccctncgtcctcgacgagctcggcgggcgccttcgaacttncgccggatcctgggcgcggcancctacattgnccgnccgcctcccggcggccagggccttacctcattccctncctcgncgcnctgaaaaatcaaggggctgctactgcgaactaccttcttccagaagctgggctctgtggccaacatggagaatgcgggcaccaatgggcttggcccgccgaaaacatcaaggcccccccgccggcttgttccggtggaaccatttcatttggccaaggtcgaggagcccccaccnagccgggggttggctcaagagggggccct

SEQ ID NO: 88137 - protein, 35 aa, Zea mays
  misc_feature: Ceres CLONE 1575365
MPGAFHSLLLPPQRKRKSKRRSRHGHRKENNPHIS

SEQ ID NO: 88138 - DNA, 887 bp, Zea mays
  misc_feature: Ceres CLONE 1575366
ctggagctccccgcggtggcggccgctctagaactagtggatcccccgggctgcaggaattcgtctcacccctagaattgtgctcagacggaacatggagaaccttttgacaaaatctctttgtgacagtaatcttcttatttatgcctgtcatccaagtcagtgaggtcctactttgatttatggacaatgtggagtagaactgtttgatcggctcttcataccagttctgttttatagccatcaattcatgaagactaatgtcacgacttgctttctcaacatatggcatctccggtaaacgtttgatatttttccaatcgatccatttgttgtcagcacatttcttcttgctataaatactgttgtatagatccatatgctcgttggaccaaaaacgcccatcgcttgcagatctgacctgttcatataaatttacaaatttaactaatttcaaagacttcttccgttttgaatttttgtagctcacaggcgtcctggctacagcctcaactagttggggcaaaccatctagaaggtcaatttgaggacagtcttcttcctttagtgtagccgcttcttcatctgagttgagcacctggagcaaactgactgagatgggccctctcccttgatggactgggcgagagccgagcaagatgcacttgctctgcatgtgcaggctctacaaccttttcatctgttagttgttcacctggagcaaaagaaggactgggcgagagctgatcaagacgcacctgccatgtcttctctacagccctttctgactgcacaggcacctgctctgcatgtgcaggctctacaacctgtgcccttgtctggtattgtggcacggttgtccacctgtgaagttgtgcatctggaac

SEQ ID NO: 88139 - DNA, 839 bp, Zea mays
  misc_feature: Ceres CLONE 1575367
  misc_feature: Encodes the peptide sequence at SEQ ID NO. 88140
  misc_feature (466)..(466): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaagctcgctcgcccgccaccgagagacgacactctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccnggccaagctggcagcatcatgctgccgtgcaagccgccgaaaggcgccgccgccgccgccgacgacgactagagcgacggccgccggagactcctctggtacccgccgtaccctggatacgatgagcccgggcaccacccgcgtttcctcgccggcgcggctccggacgactactactgcagtgaccaaggcaaggtgtccctcatctcctcgggcggggcgtcacagctgcacatcttcatcttcgtgctcgcggtggttcatatcgtctacagcgtcgcaacatgggcgctggggcgtctcaaatggagaaatggangaaatggggatccggaaaccaactccctggaatccagtacgcaaacgacccttt

SEQ ID NO: 88140 - protein, 108 aa, Zea mays
  misc_feature: Ceres CLONE 1575367
  misc_feature (5)..(108): Pfam Name: Mlo Pfam Description: Mlo family
MAGGGGGRDLPSTPTWAVALVCAVIVLVSVAMEHGLHKLGHWFHTRQKKAMREALEKIKAELMLMGFISLLLAVGQTPISKICIPGQAGSIMLPCKPPKGAAAAADDD

SEQ ID NO: 88141 - DNA, 853 bp, Zea mays
  misc_feature: Ceres CLONE 1575369
  misc_feature: Encodes the peptide sequence at SEQ ID NO. 88142
  misc_feature (364)..(364): n is a, c, t, g, unknown, or other
  misc_feature (370)..(370): n is a, c, t, g, unknown, or other
  misc_feature (372)..(372): n is a, c, t, g, unknown, or other
  misc_feature (375)..(375): n is a, c, t, g, unknown, or other
  misc_feature (377)..(377): n is a, c, t, g, unknown, or other
  misc_feature (400)..(400): n is a, c, t, g, unknown, or other
  misc_feature (435)..(435): n is a, c, t, g, unknown, or other
  misc_feature (565)..(565): n is a, c, t, g, unknown, or other
  misc_feature (796)..(796): n is a, c, t, g, unknown, or other
ggagctccccgcggtggcggccgctctagaactagtggatcccccgggctgcaggaattcgtctcaccccctagaaaaacccccccccccttcctagtcagttcccccacctcatgactcctgaggtcttgctctagctcgagcgccatggccacgtctcgctgcggtaaacagcggcagccgctcctccactctcccacgcccgcagacgccaacggtggcggcgcagccaagaggcgcaggttcgtctcgttcctcgccgtcacggcagctcttgtcgcgtcctaccacctcctcgtgccaaccaattcgtcgcactaccacgcactattcctctccctcggttcctacgccccacgcggcngcccancntangngcgctcacccttccgcccccaangttggttggcaccgaaggcaaacgcgggccaccgncccgggtacgtgcctccaaggccttctccctccctttttcctttcccaagaaaaaattaacccccttaaaccggggttttctcccttcccataaccccgggtcacacgggtttccccttttccccttttncgaggggggggggccccggggggtcaaaacccccccccaagggggccgggttttcccccttttgggggggggggaaaaaaacccccccaaaaaaggggggggccccccccccttttctctttatgggggcccgcccccccccggagagaagacgcctccccccacccaacaaaaaaaatttttctcccccccctcccccccggggagagaaaaaaaggggggggggctccnccccccccccccaagagagaggagaagggttgttgttttttataaccaaacaacaac

SEQ ID NO: 88142 - protein, 115 aa, Zea mays
  misc_feature: Ceres CLONE 1575369
  misc_feature (73)..(73): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (85)..(85): Xaa is any aa, unknown, or other
MATSRCGKQRQPLLHSPTPADANGGGAAKRRRFVSFLAVTAALVASYHLLVPTNSSHYHALFLSLGSYAPRGXPXXXRSPFRPQXWLAPKANAGHRPGYVPPRPSPSLFPFPRKN

SEQ ID NO: 88143 - DNA, 894 bp, Zea mays
  misc_feature: Ceres CLONE 1575371
  misc_feature: Translation starting site: 336
  misc_feature: SWISSPROT Homolog: EC 4.3.1.5 Phenylalanine ammonia-lyase
  misc_feature (697)..(697): n is a, c, t, g, unknown, or other
  misc_feature (698)..(698): n is a, c, t, g, unknown, or other
  misc_feature (703)..(703): n is a, c, t, g, unknown, or other
tggagctccccgcggtggcggccgctctagaactagtggatcccccgggctgcaggaattcgtctcacccctagaaaaaaaggaagagcagcaccatcaccagctcttctccatcaagagtaacaggccatcgccttaccagttctgatcccaatcatttacggcgtaggtgcctcttgctcaaaacccagccccacagcaatggagtgcgagaacggccgcgttgctgcaaccaacagcgattccctgtgcatggcgacgccccgcgccgacccgcttaattgggggaaggcggcggaggagctgatgggcagccacctggacgagtcaagcggatggtggccgagtaccgccaacccttggtgaagatcgagggcgcaagcctcagcatcgcgcaggtggccgctgtggccaccggcgctggcgaggcccgggtcgagctggacgagtcggcccgtagccgggtcaaggcaagcagcgactgggtcatgagcagcatgatgaacggcaccgacagctatggcgtcaccaccggctttcggcgccacgtcgcacaggaggaccaaggagggcggcgctctccagagggagctcatcaggttcctccaacgccggcgccttcggcacccggcgcggacggccacgtcctgccggccgtagcgacgcgcgcggccatgctcgtccgcataacaccctnnctccnaggtactcccgcatccgcttccaatccctcgaggcgatcgtaagctgcttcacgccaaactcacgcctggccgggcccctcccccgaacgggtcaccgcgtccggcgacctcgtgccgctcctcctaatttgctggcctccttcaccggggggtgaagaactctggttgcgctcgccccaaaaggcaacaa

SEQ ID NO: 88144 - DNA, 1009 bp, Zea mays
  misc_feature: Ceres CLONE 1575373
  misc_feature: Encodes the peptide sequence at SEQ ID NO. 88145
  misc_feature (497)..(497): n is a, c, t, g, unknown, or other
  misc_feature (506)..(506): n is a, c, t, g, unknown, or other
  misc_feature (507)..(507): n is a, c, t, g, unknown, or other
  misc_feature (534)..(534): n is a, c, t, g, unknown, or other
ctggagctccccgcggtggcggccgctctagaactagtggatcccccgggctgcaggaattcgtctcacccctagaaaaagagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaggtggccctgggctcggcggcgttcgccgtgttctgggtgctggcggtgttcccggcggtgccgttcctgcccatcgggcgcacggcgggctccctgctgggcgccatgctgatggtgctgctgggcgtgatgagcgccgactacgcctacgccgccgtggancctgccatnnctgggctgcttgtcggcaccatggtgntgagcgtgtacctggagcgcgccgacatgtttcggcacctgggggcgcctgctgtcttggcggaaccagggcgggcgggacctgctggtgcgcaacttgggccgggttcgggcttgcttccgggttcttaacaaaggacacctgtggctgtgggctcaccgagttcttcctaaaaatgggggggcaaaaaaacttgcccccggccccccttctgggtgggggtgggggtcagggccaaaattgggtcccccccccccccattggggaaacccctaaaacgtggtttcgcggggaaaggggattctcctttggggggtttttttggggtatcccccggcacccttgtgggtcctaataaaaaggcctttgtgtgtgcccttttggaaaaagtgggaggggggagacccccccccccgaaccaaagaggtggctctcccccccgaggttaagaaagaaggaactctccaccctcctc

SEQ ID NO: 88145 - protein, 117 aa, Zea mays
  misc_feature: Ceres CLONE 1575373
  misc_feature (62)..(62): Xaa is any aa, unknown, or other
  misc_feature (65)..(65): Xaa is any aa, unknown, or other
  misc_feature (66)..(66): Xaa is any aa, unknown, or other
  misc_feature (75)..(75): Xaa is any aa, unknown, or other
MAMDPVLKVALGSAAFAVFWVLAVFPAVPFLPIGRTAGSLLGAMLMVLLGVMSADYAYAAVXPAXXGLLVGTMVXSVYLERADMFRHLGAPAVLAEPGRAGPAGAQLGPGSGLLPGS

SEQ ID NO: 88146 - DNA, 926 bp, Zea mays
  misc_feature: Ceres CLONE 1575374
  misc_feature: Encodes the peptide sequence at SEQ ID NO. 88147
  misc_feature (578)..(578): n is a, c, t, g, unknown, or other
acccgcggtggcggccgctctagaactagtggatcccccgggctgcaggaattcgtctcacccctagaaaaagcccacacccacctattccgctattcgatctctcgttcgacctcgtctctcttccccttctgctttgccttttccccttcctctctcccctgtcccccctccgtcccagccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgctatcgccgaggaggtggcggaggaggagaggatcatcgaggtcgacgaggtgatgcgtagcgaagggatggcggcggtggcgccgtcggaggcggatgggtgggttgaggcggagaaggcgccggcggtggtcgtcgcggaggtgatggagccggagagcttgcccgaagaggagggggttcccgtgaaggctgttcgggaggtgcgccttgctgcngaagtggaggagggggaggacggtggtggcgtgctgaatcggcctgatttgacctcggcaactgttgttgcggccgcgggtggctgaacctagccagctggtgtcggggcgctgaagttgtgcccaagggaagtttctgatgccggcaagtttggaaggaaccaaccgtgcaggatgttgtggtgaaccattatgatccggggggctgaggttgccccttgttccccttgtaggtctccaagacggaccgggacagcaggaatataaattgtttggattggccaaagggcccccttggaaaataaacttgcgaaagtgaacaacacctcctgtgtgcaaagaggggcc

SEQ ID NO: 88147 - protein, 140 aa, Zea mays
  misc_feature: Ceres CLONE 1575374
MELFYELLLTAAVTLLAALLLATLFAANDSHRRTDRAAAAIAEEVAEEERIIEVDEVMRSEGMAAVAPSEADGWVEAEKAPAVVVAEVMEPESLPEEEGVPVKAVREVRLAAEVEEGEDGGGVLNRPDLTSATVVAAAGG

SEQ ID NO: 88148 - DNA, 937 bp, Zea mays
  misc_feature: Ceres CLONE 1575375
  misc_feature: Encodes the peptide sequence at SEQ ID NO. 88149
  misc_feature (523)..(523): n is a, c, t, g, unknown, or other
ctccccgcggtggcggccgctctagaactagtggatcccccgggctgcaggaattcgtctcacccctagaaaaagttccgctcgctcgcccgccaccgagagacgacactctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaaggcgcggcgncgccgccgacgacgaccagagcgacgggcgccggaaatccctctggtacccccgtaccctggataccattagcccgggcaccaccgccttttcctcgccggggcggggttccgaagaaaaatacgggggggacaagggaagggggcccttattccccggggggggggccacagggggaaatttttattttggggccgcggggggtcaaaatggttaaggggggcccccaggggggggggggggcccaaaagggaaaaggggaaaatggggttcggaaaacccccccgggtaaaccggtggaaaagcccccttggggttggggtgacacccaaaaaaattttttaaaaaagactggtggccttttaaccccccggggagagagagggggggggttttcggagtgtttccccccag

SEQ ID NO: 88149 - protein, 240 aa, Zea mays
  misc_feature: Ceres CLONE 1575375
  misc_feature (5)..(237): Pfam Name: Mlo Pfam Description: Mlo family
  misc_feature (103)..(103): Xaa is any aa, unknown, or other
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKGAAXPPTTTRATGAGNPSGTPVPWIPLARAPPPFPRRGGVPKKNTGGTREGGPYSPGGGPQGEIFILGPRGVKMVKGGPQGGGGAQKGKGENGVRKTPPGKPVEKPPWGWGDTQKNFLKKTGGLLTPRGERGGGFSECFPP

SEQ ID NO: 88150 - DNA, 968 bp, Zea mays
  misc_feature: Ceres CLONE 1575376
  misc_feature: Encodes the peptide sequence at SEQ ID NO. 88151
gcggtggcggccgctctagaactagtggatcccccgggctgcaggaattcgtctcaccccctagaaaaagtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaaccttgctcagttcgacagagaacgtatccctgaacgtgttgtgcatgcacggggagccagtgccaagggtttctttgaggtcactcatgatgtctctcaccttacatgtgctgattttctccgtgctcctgggggtcccagaccacctggttattggtccgtttctctacagttgtgcctgagcgtgggaagccctgaaaccttgaaggatccacgtgggttttgctgtcaagttcttaccccgaagaggggtacttttgacctcggggggaaacaaacatgcccggtggtttttcaatccgagaaggggatgaaaattccctggaaaggggcccacgctttttcaggccgaattcaaagaaccattttggccggaaaaacggggaaaatagtagattttcttccctccccccccccgaagggctcaccctgggttccccttcctcctttgaagaaggttggggatccccactcaacatacagggcacagggaagggcctttggtggtcatagcctacccccttgttcaaaaggggaggggaaagcctcccccttgggggaattcccttgggaaccctacctggggggggggaaagccttgcctcacacaagaaacctgt

SEQ ID NO: 88151 - protein, 256 aa, Zea mays
  misc_feature: Ceres CLONE 1575376
  misc_feature (18)..(254): Pfam Name: Catalase Pfam Description: Catalase
  misc_feature: SWISSPROT Homolog: EC 1.11.1.6 Catalase
MDPYKHRPSSGSNSSFWTTNSGAPVWNNNSALTVGQRGPILLEDYHLIENLAQFDRERIPERVVHARGASAKGFFEVTHDVSHLTCADFLRAPGGPRPPGYWSVSLQLCLSVGSPETLKDPRGFCCQVLTPKRGTFDLGGKQTCPVVFQSEKGMKIPWKGAHAFSGRIQRTILAGKTGKIVDFLPSPPPKGSPWVPLPPLKKVGDPHSTYRAQGRAFGGHSLPPCSKGEGKASPLGEFPWEPYLGGGKALPHTRNL

SEQ ID NO: 88152 - DNA, 922 bp, Zea mays
  misc_feature: Ceres CLONE 1575377
  misc_feature (860)..(860): n is a, c, t, g, unknown, or other
ctcaccgcggtggcggccgctctagaactagtggatcccccgggctgcaggaattcgtctcacccctagaaaaaatctccctctccgaccagcagcagagcacaccatcctctccactcggatccccaagccctcgcctctagctcttgccacagcatcgatcccctgctcggacctccacccggacgcgtcctcgccggtggacagcgccgctgcatcgcccttcatagctgtcggccttggcaccgcttccccgagcgccacagtcgagctcgcccatcctctgctctagccctttctccacaccgtcgctgagctcgcccctcccctcagccatggacacgacgacctgcagcccttcttggtgaccaagcccatcttccgactggcgacccctctttttccaactctgcgcgtatcatctcgtccaacccccatggtgtttcctccatctcagctcccttgatccctccctgtggcgttccccctggatgtaggagatctgttccccacgatacgagcaaatgtactttccatccctgctgcaacaccttggtggttgtcgagcatcacgtacagcttgcccagcctctgtcacgacattgttcagcccggtgcgcttgtgatcgacatgcgagggccagggcctatgctgaccccaagtggtggaaaggatggcctacatctgagaggaatatcggccgaccaatctggaagattggtgattccgacacaagaatcttgattccctggattccaactcagaacctagcgtttccgccatttgtttttgcctcccacattggcctccgacctcatgacatttggaaaaagaatgcgctgttccttgaaacaccaanccaaagtccgcattttcctttccgtgcctattttttagttaagggaggaaggcaactttccc

SEQ ID NO: 88153 - DNA, 948 bp, Zea mays
  misc_feature: Ceres CLONE 1575379
  misc_feature: Encodes the peptide sequence at SEQ ID NO. 88154
  misc_feature (641)..(641): n is a, c, t, g, unknown, or other
ctggagctccccgcggtggcggccgctctagaactagtggatcccccgggctgcaggaattcgtctcacccctagaaaaaattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcggctgcccccgcgtccgcgccaagctcgccgccgcggggctggggctgggcccgggcctgccgctgccgagtgcgagcgccagcgccagcgctaacggcaccgcggaggaccctgcggcggcgtccgtcagcggcggcgccgcgtggcgcggagccgcgaggtgcgaggacctggcagcgcgccacgtcggggtgctcgtncagggctggacctggatccctgacgcgctcgacggcgtctacacctgccgctgcgggggtagctgcgtctggagcaagtctgccgccgccgtcgaccgtcccgacgcgctgctctttgagggcgcccacgctccgcgcagcttataaaaagtatgagccgggtttctcagctatgcagcttagagcaagttgatatacggcctctgcacctagatgaaggtttgctctcgtggttacctgatctggagcagtagaagcaactggtttgaggactttggcggtacagtgcatgatgatggcagtacta

SEQ ID NO: 88154 - protein, 190 aa, Zea mays
  misc_feature: Ceres CLONE 1575379
MLFPKRINYVAPMLASAAILLLLLSGYFELPSISTPAPLLAGAARFPTALDSVGSRDRDPFTSLLEAFASWDAAVGCPRVRAKLAAAGLGLGPGLPLPSASASASANGTAEDPAAASVSGGAAWRGAARCEDLAARHVGVLVQGWTWIPDALDGVYTCRCGGSCVWSKSAAAVDRPDALLFEGAHAPRSL

SEQ ID NO: 88155 - DNA, 982 bp, Zea mays
  misc_feature: Ceres CLONE 1575380
  misc_feature: Encodes the peptide sequence at SEQ ID NO. 88156
ctccccgcggtggcggccgctctagaactagtggatcccccgggctgcaggaattcgtctcacccctagaaaaagctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacagcgtctgcagcggtgagctgcggcgaggtgacgtcgtcggtggcgccgtgcctcgggtacgcgatgggcagcgcggcgtcgccctccgcggcgtgctgcagcgtggtgcgctcgctactcagccacacgtcgtccgctgcggaccggcatgtcacctgctactgcctcatgatcatgacggacgtgctcggctggcagcgtcagcatgggcaacggctgcaacatcccactgaaagtgccggcgtctccgttctgattgcccatcaagcccaacctgggactgcaacaagatacaactgatcgatgggacccataatggaaggtaacccccctcgttgggatggcagcctaaagggggcattcaacaactttgcaaatctccccgggccaaaaatggccaaaaccccgtgggggggccccgccccaaaccgggcccaattttggagaaatgcccctttgtgccccccctttgggtcccctccccctgggtttcccgcgcatcccctgtttggcgaagcgccccccccgggggtgaccccaaaaaggaaaaaccccttgtaagggctctttaaaaaaaaccccccccaaagcccgggggtgtttataccgggccccccccctccccggggggtggttttttatgggcgaaggaaaaaaaaccgggcacccagggaaagcgacaaacccccggggggggggccacaaccaaccacac

SEQ ID NO: 88156 - protein, 128 aa, Zea mays
  misc_feature: Ceres CLONE 1575380
  misc_feature (36)..(116): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSVVRSLLSHTSSAADRHVTCYCLMIMTDVLGWQRQHGQRLQHPTESAGVSVLIAHQAQPGTATRYN

SEQ ID NO: 88157 - DNA, 938 bp, Zea mays
  misc_feature: Ceres CLONE 1575382
  misc_feature: Encodes the peptide sequence at SEQ ID NO. 88158
  misc_feature (682)..(682): n is a, c, t, g, unknown, or other
  misc_feature (938)..(938): n is a, c, t, g, unknown, or other
ctccccgcggtggcggccgctctagaactagtggatcccccgggctgcaggaattcgtctcacccctagaaaaagtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggaagagcaccctccacttggtgctgcgcctcaggggaggcatgcagatcttcgtgaaagaccctggacgggcaaactatcaccctcgaagtgggatcttcagacaccatcgacaacgtncaaggcaagatccaggacatggaagtcattcccccagccagcagcggctcatctttgctggaaagcagcttgaggacgggcgcacgctggccgactacaacatcagaggagagcaccctccacttggtgctgcgcctcaggggaagcatgccgattcttcgtgaaaccctgactggcagactatcaccctcgaagtggagtttcagacacatcgacacgtcaaggcaaatcccggaaaggaggctccccccgaacn

SEQ ID NO: 88158 - protein, 202 aa, Zea mays
  misc_feature: Ceres CLONE 1575382
  misc_feature (6)..(74): Pfam Name: ubiquitin Pfam Description: Ubiquitin family
  misc_feature (82)..(144): Pfam Name: ubiquitin Pfam Description: Ubiquitin family
  misc_feature (179)..(179): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKEEHPPLGAAPQGRHADLRERPWTGKLSPSKWDLQTPSTTXKARSRTWKSFPQPAAAHLCWKAA

SEQ ID NO: 88159 - DNA, 898 bp, Zea mays
  misc_feature: Ceres CLONE 1575383
  misc_feature: Encodes the peptide sequence at SEQ ID NO. 88160
ctggagctcaccgcggtggcggccgctctagaactagtggatcccccgggctgcaggaattcgtctcacccctagaaaaaacgaccgatcggaaatcccatctcccctgcccacccagagagagaaaaaaaaaatcacaccaaatcccctccccccgatccatccatcccatcccgccgccgccgcgcgccgctgcctagatccgccttccctcccccgctccccgccgccatggcgtcctcccgcacctcctgggccgacgtcgccgacgccgagcccgccccgcctcccccggtcgccgcccccgccgccgcatccaacggccccgcgcgttcctcctacgttccgccccacctccgcaaccgcccaccagccgccgccgccgccgcgaccgcctccgccgccccaccgaccagcgctccaccggccgggcctccctcaccccggcaaccgggcgggcgggcaggcaagcttttctggtcacagggcggcagccggcggtcggccgaagaaagattcgggggggggccccgccccccgggcgggggcccgggtgggaacgcgaagcccggaaccccgttagggggaaacccccccgcccgaaaaccccaaggggccccgttttggaaaaagggcccccaaaaacccgggggtaaaaaatttttaccgcggaaaaaggggaatcccccggggtagaaaatttccccgggcggaaaaaaatattgcgccccccctggttcgaaaaattttgcggaaaatttgaacacgtggggaaagagccccctaaaaaaaaaaaatttcccccgggggggaaaagtatatttgcccccccccaccccgggggagggcgacgacccctccccgaatttcttctttccggggggcgggaaaaaatatg

SEQ ID NO: 88160 - protein, 154 aa, Zea mays
  misc_feature: Ceres CLONE 1575383
MASSRTSWADVADAEPAPPPPVAAPAAASNGPARSSYVPPHLRNRPPAAAAAATASAAPPTSAPPAGPPSPRQPGGRAGKLFWSQGGSRRSAEERFGGGPRPPGGGPGGNAKPGTPLGGNPPARKPQGAPFWKKGPQKPGGKKFLPRKKGNPPG

SEQ ID NO: 88161 - DNA, 688 bp, Zea mays
  misc_feature: Ceres CLONE 1575387
  misc_feature (284)..(284): n is a, c, t, g, unknown, or other
ggagctccccgcggtggcggccgctctagaactagtggatcccccgaggctgcaggaattcgtctcacccctagaaaaagcttgctttgtcacgcacacgaaaagctcctgcctttaccttatctccgcacccgtagtgggatttggtgggagctgcgctgctcgcccctcgcgtttctttgctcaattgggggtcacggtcacggcccgcgggtgctgcgcgtgctcgtgggcgggcagaattcgggggtcttgcgcggtcccggtcccctcggccaattgcngaacgcctctctgcagatcttttcccggtaaactcccggggaacccccccccggaaatattaaaactgggggggggccgcccccaaaaaaatttttcccccccgggggtttggggcccccttttttggctttcccctcaacccctgaaaatggggggacccacctttttttggggggccccgcaaaaaaaaattttttaaaccccggggggggccaaaaaaatttgaaggggggggttccccccccccccccggggggggggaaaaaaataattttaggggggggggggggccccccccccccccccgcggggtttttttttttataaaaagggggggcgccgccccctcccccccccctgccggggggggggagatattttttctttcccccccacccaaaaa

SEQ ID NO: 88162 - DNA, 950 bp, Zea mays
  misc_feature: Ceres CLONE 1575395
  misc_feature (882)..(882): n is a, c, t, g, unknown, or other
  misc_feature (932)..(932): n is a, c, t, g, unknown, or other
ctggagctcaccgcggtggcggccgctctagaactagtggatcccccgggctgcaggaattcgtctcacccctagaaaaactcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatcctccacctcgtgctttcgcacaatggggttcgacgtggcggctcaaccgtcttcttagatcaccatctcggtggagacggttgaagtcttcacaccctctcgacctctttgctgtctcattttttttaactgtcaaggataagcaagtgaacctctgtgtgcataccaccaccaccatacgtagcatacacaggcacagatggcagagcataaagggaacgttctcttgcacaagtatgaagatggggaaattgcttggccaaggcaccttttgcaaggttttacatgctcgtaacacgcgaacttcgaaagtgtcgcgatcaagtgattgataaggagaaaggtaatgaaggttggtctcattgatcaaatcaggcgagaaaattctgttgatgaagcctggtagcatcnaaactccgtaaaggctctttgaagtcatggccacaacaaccaaaaatacnttggtgctgggacagggt

SEQ ID NO: 88163 - DNA, 907 bp, Zea mays
  misc_feature: Ceres CLONE 1575402
  misc_feature (723)..(723): n is a, c, t, g, unknown, or other
  misc_feature (743)..(743): n is a, c, t, g, unknown, or other
ctggagctccccgcggtggcggccgctctagaactagtggatcccccgggctgcaggaattcgtctcacccctagaaaaatcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaaacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatgggggcgctctccgcgcccctccgcgccgtctgcgcctgatcccgcgtcgccgcgtccgaccccgtcaaggtctcgtgcgtgaggagcactggctcagctcacttcggctgcgccttnccctacatcagggcctcctnctcggctgcgaggaactcgagccgctgagggcgatatgcacgcaggcggcccctggcatgccacattattcgagtggggagagacaagatgggccatcacgggtttgggccgttgggcaagttggtcctgccaattgcaccagcaaagatgatattgaagtgtg

SEQ ID NO: 88164 - DNA, 929 bp, Zea mays
  misc_feature: Ceres CLONE 1575404
  misc_feature: Encodes the peptide sequence at SEQ ID NO. 88165
  misc_feature (738)..(738): n is a, c, t, g, unknown, or other
  misc_feature (774)..(774): n is a, c, t, g, unknown, or other
  misc_feature (877)..(877): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcacccctagaaaaaagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgaacgtcccgcgcgctgcacgagtgatgaagccaggggagaaataaaataaagccgctgtattgccaggagcagcatgcattatttatcgatctatatatatactgtactgtagtactctattatatatgtatatatgtgtggcctgcagtgcgagttgcttcgatccacctacttgntcacacagtttaaaaaaaaaaaaaaaaaaacaaccncggacaccgcaccgcaacgtagccggctaggggaagactcttttctttcagctgtgccgtgcacacgcacgacgctgttggttgctcccccccataaacctcntgaacgctaacggcngaacacacagcggcgatgcaagcgaccggtttccgcg

SEQ ID NO: 88165 - protein, 123 aa, Zea mays
  misc_feature: Ceres CLONE 1575404
  misc_feature (34)..(119): Pfam Name: Tryp_alpha_amyl Pfam Description: Protease inhibitor/seed storage/LTP family
MAAVLNSRKTAQAVVAVLVAAALLASSTSAAITCGQVGSSLAPCIPYATGRASALPASCCSGVKSLNSAARTSADRQAACRCLKSLANSVKSVNMGTVATIPGKCGVSVGFPISMSTDCNKIS

SEQ ID NO: 88166 - DNA, 953 bp, Zea mays
  misc_feature: Ceres CLONE 1575406
  misc_feature: Encodes the peptide sequence at SEQ ID NO. 88167
  misc_feature (628)..(628): n is a, c, t, g, unknown, or other
  misc_feature (703)..(703): n is a, c, t, g, unknown, or other
  misc_feature (793)..(793): n is a, c, t, g, unknown, or other
  misc_feature (818)..(818): n is a, c, t, g, unknown, or other
ctggagctccccgcggtggcggccgctctagaactagtggatcccccgggctgcaggaattcgtctcacccctagaaaaaagaagaaagaagccgtgtccgcgtgattttctgggtgaatttttcccggcctccgctccggccagatcggcgcgggtgaaccccggcccctaccgatccggatccgtccccatcgcctcgtgtgttttccgtcgagtattttagcgtgtgtgtctccccttcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggatatttgtcgttgaatagataggtgaagttgctgtaaacattgcttaccgtgtaggggactgtaaagaatcgttcacgctcgtgcaggctgtgacgaattcgctcgatggttcgggctgatctctgagatgaccccgagctgacgtacccatttcacaacggcaccgaccgtgaagcgactcatcatgggcaggcttagcnttgtctgttgttagctgttggtgcttaggtcgtgcatatttctgaaacatgatcggttaagagtatttggctatnctgcatggggtgtggggcacttcatcatctgtctgcatacgggggtggagatttacgtaaaaccaacttggacctgtgaggcattatgtncttttttacagaaaattaggtatcntgctacctaaagttgctagatttgcatgctagatcatcacatccctagctaaaggatccatgtaatgtaaaaccatcctgaggttgggatagaaatggaaatttgggtgggaatccaagggccttaaaaggaaaa

SEQ ID NO: 88167 - protein, 73 aa, Zea mays
  misc_feature: Ceres CLONE 1575406
GAPRGGGRSRTSGSPGLQEFVSPLEKRRKKPCPRDFLGEFFPASAPARSARVNPGPYRSGSVPIASCVFRRVF

SEQ ID NO: 88168 - DNA, 1155 bp, Zea mays
  misc_feature: Ceres CLONE 1575407
  misc_feature (1155)..(1155): n is a, c, t, g, unknown, or other
ggagctccccgcggtggcggccgctctagaactagtggatcccccgggctgcaggaattcgtctcacccctagaaaaaagaagaaagaagccgtgctccgcgtgattttctagggtgaatttttcccggcctccgctccggccagatcggcgcgggtgaaccccggcccctaccgatccggatccgtccccatcgcctcgtgtgtttcccgtcgagtattttaccgtgtgtgtctccccttcttctcttctgtagaaacatgcagatatctccggtagatctggtggcttagttctccttgaacgcgcgcggccgcgatgtctcggtttgtagcttgcaatcttccggtggagcttgaccgctaacaaattttgattttttgcctggctgttttgatacttggccccccctgtgtgggttccgcgcgatcactagccccgaaaactataagtgaaaattgttagaaaacatttctttaacggtgtttaggtattgtaaaacaatccttcgacgctccgtgctaagctggtgaccatattcgtcgtctttgggtttggggcttgtttctcctgggaattaccgccccggtcgtgtacgtgtggctgttttcacaattgcgtgttacgtacccggcgcatgtcggtctcatttcttttgagttaagcgccttttggcgtgttttccccgtgttgtgttgaccctctatttgcgtggcacgatgagcgctcggggacaatattctctcgtgtaaaagacggattgttaccgcgttggtaaagaatgttcagtttgacgcatacatcatgtgccattggtggtaacttcagtgggatatatattattcgtcactctccctggtccgggcgattcacatagcgctgtgagtcattgtcccttttacctagcggcgatagctgatgtctgctcgtgttctgctcccttaggagggccttgtttgtgttagaattgaattgtccgagggcgttcgctccccgaacatcatgttgttttctatatacatcagcagttgcgtcgcatgtaggtctatttgcgcggaacacgtgcggctttctattgcagtaggatgtacacttttctaccagcgcgtttggttaaggtaacagtagttctcctcgcgtgttgttatcctacacn

SEQ ID NO: 88169 - DNA, 916 bp, Zea mays
  misc_feature: Ceres CLONE 1575408
  misc_feature: Encodes the peptide sequence at SEQ ID NO. 88170
  misc_feature (76)..(76): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (403)..(403): n is a, c, t, g, unknown, or other
  misc_feature (475)..(475): n is a, c, t, g, unknown, or other
ggagctcaccgcggtggcggccgctctagaactagtggatcccccgggctgcaggaattcgtctcacccctagaananannaaaaaaaaaaaaaaaaaaaaaaaaaaaaattcgaccctcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacanctaaaaggttttatggttgtgccaatgggagtcatttttgacatgaatttatctgctctacgggcgaggatngatactgccctttaaagttgggccctgaacgtgaacttggtcctgacctacaccgaatgaggaagggggaaattggcatggcaaatgatggatgatgacttgcgtgatgcaaccttcccgccaagaattaaaaccctcccagggataccgggtccaccgggaagaaaaaccacccacctgaaaaaaaaaaaaccttctggacccatgggaaatccgggggccaaggatccccctttccccaattaaagggcccccttttgaagggttttaaacccgtttccgaaaaaaaattccgggcccctaataaaaaccccctttggggagaaaaaaaaaaggtttccccaggaaccaaaaccggaggggcgctgggaaaaattttcccaaaaaaataggggggccgcccccccccccttgggggggggaaggaaaccttcttgcaac

SEQ ID NO: 88170 - protein, 46 aa, Zea mays
  misc_feature: Ceres CLONE 1575408
  misc_feature (34)..(34): Xaa is any aa, unknown, or other
MSDWSSPAAPTFFPFGPQAEGWDVTFKVKYGDTXKRFYGCANGSHF

SEQ ID NO: 88171 - DNA, 944 bp, Zea mays
  misc_feature: Ceres CLONE 1575409
  misc_feature: Encodes the peptide sequence at SEQ ID NO. 88172
  misc_feature (775)..(775): n is a, c, t, g, unknown, or other
  misc_feature (786)..(786): n is a, c, t, g, unknown, or other
  misc_feature (789)..(789): n is a, c, t, g, unknown, or other
  misc_feature (791)..(791): n is a, c, t, g, unknown, or other
  misc_feature (792)..(792): n is a, c, t, g, unknown, or other
  misc_feature (836)..(836): n is a, c, t, g, unknown, or other
  misc_feature (889)..(889): n is a, c, t, g, unknown, or other
  misc_feature (896)..(896): n is a, c, t, g, unknown, or other
ctggagctccccgcggtggcggccgctctagaactagtggatcccccgggctgcaggaattcgtctcacccctagaaaaaagcccaaaccagtttagagttcgaactccgttgggttcgtctcgttttggtcccacgttctcgcagctgacgccgccccgttcgcctccgtcgccgccgccatcgccaccgccgaaccatggagatcacggagccgtcgcgtggcaccaagcgccctctcaccgccactgcaggcgatgacgacgatgctggcctggagcgcaagccgcggttccctaaggggaagaaggccaagtaccgcgacgtcggtgcggagggaggcccctctggcaacgctgtggacctcgacagcatgctgaatccggagcttgcggcggagcggcgggcgcggcagcgccacgtccagctcaaggagggagacgacgcgaagggaggtgccgctgaggtgaagggcttcgaagtccgctacaacgacagtgttaactttgttgacgatggtatacggatagagccgtttaacttggagcgagaaagggaagaagggtatttcgatgagaatgggaactttgtggagtatgcaagaggcaatgagattaaggatgcttggttggacagtgtggaagttgacccaacatatgctgcaaaggttcagaacaaaggcaaagagaaagtagacgagtttgaggacctctcttccgatgacattgggaggctaaaaagcagatagcatacttgcttgagccaggagtaacgantatggcagccntgnannaggttgaaggtacatccacggataaacgtggatagatgggtganggggactaacgtatatttgatgaattgactgaagctgccatgaaagctatgtnagacggncgattatatgtttactcagatgatcgtgagacccttgaacgcctagct

SEQ ID NO: 88172 - protein, 182 aa, Zea mays
  misc_feature: Ceres CLONE 1575409
MEITEPSRGTKRPLTATAGDDDDAGLERKPRFPKGKKAKYRDVGAEGGPSGNAVDLDSMLNPELAAERRARQRHVQLKEGDDAKGGAAEVKGFEVRYNDSVNFVDDGIRIEPFNLEREREEGYFDENGNFVEYARGNEIKDAWLDSVEVDPTYAAKVQNKGKEKVDEFEDLSSDDIGRLKSR

SEQ ID NO: 88173 - DNA, 957 bp, Zea mays
  misc_feature: Ceres CLONE 1575412
  misc_feature: Encodes the peptide sequence at SEQ ID NO. 88174
  misc_feature (788)..(788): n is a, c, t, g, unknown, or other
  misc_feature (845)..(845): n is a, c, t, g, unknown, or other
  misc_feature (848)..(848): n is a, c, t, g, unknown, or other
ctggagctccccgcggtggcggccgctctagaactagtggatcccccgggctgcaggaattcgtctcacccctagaaaaatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaacaagttcggctcctgtcgtcacgcgaccgcggtccactcgcaggggcagtgaccgtgctgctgccggcgacggcgacggcgaggatcctggggtcgcggcatgccgagcgagagatctcgacgaggccatctcgtcgctgttcctgttcccactggcaacgctaccgagagacttttnaggcggggcgtcgcgcctgcctacatgatggtgcgaagcgcgcgacgttcccgtacntcntagcggcgaatgaaccccggcatgtgggaacaacaacggcttggcaacgaccccaagcctgcgggggctccaaggcgccctggaactgggctctcgcccgccgtccaaa

SEQ ID NO: 88174 - protein, 222 aa, Zea mays
  misc_feature: Ceres CLONE 1575412
  misc_feature: SWISSPROT Homolog: EC 3.2.2.22 rRNA N-glycosylase
  misc_feature (214)..(214): Xaa is any aa, unknown, or other
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVVTRPRSTRRGSDRAAAGDGDGEDPGVAACRARDLDEAISSLFLFPLATLPRDFXGGASRLPT

SEQ ID NO: 88175 - DNA, 919 bp, Zea mays
  misc_feature: Ceres CLONE 1575413
  misc_feature (492)..(492): n is a, c, t, g, unknown, or other
ctggagctcaccgcggtggcggccgctctagaactaagtggatcccccgggctgcaggaattcgtctcacccctagaaaaaacagcagtccgcaccgcacacacacgcacaggcagcagcacagcgatctgccttctggcccggcccccttccagcccagagcaacagcagcgcggtgccggccggcaaccgcaactggtgatcaagtctctgggggtcctcctcctcctccatcccccctcaaacctccccgtgtcggctcctcccgaatcctcacaagtagccccgcgcgccacctcgctgtcggtcgccggcacacagatagagaaagagagagagactgctaagagagagagagagggaacccacagaccagaacaagagcgaagatggtcggagtcctcccccgagacaatgccaccgcggagacagacgtcctcctccacgcccgagacttcaatggacggccgggccccccgggcaccacagggnagttggggcgcgccccccctcatatctcttgtggggaagtgaaaaaaaagggggagaaaacctggggaatcaccctgaaacccggtggagtacctcaaagaggagccatcaaccttgtgggaacaccaaaaaaacccccaaaagttttcccaaaatttttgggggggcccccctctttgttttggcccccccggggggggtgttttgggaaaaaatttcttcttggggggggcccgtcccacgccatttttaactccctctaaggttcccgggggggggggggcggccggaaaaaaataaaaaaaaatcccgggcccgggcgggcggggttttttttttttttccctccgctaaaaaaaaaacccattttaaaataaaaaaaaaaacgcgagtccccggcgcccaaggggaattgttgtggtgtctt

SEQ ID NO: 88176 - DNA, 897 bp, Zea mays
  misc_feature: Ceres CLONE 1575414
  misc_feature: Encodes the peptide sequence at SEQ ID NO. 88177
  misc_feature (809)..(809): n is a, c, t, g, unknown, or other
  misc_feature (812)..(812): n is a, c, t, g, unknown, or other
  misc_feature (822)..(822): n is a, c, t, g, unknown, or other
  misc_feature (833)..(833): n is a, c, t, g, unknown, or other
ctacccgcggtggcggccgctctagaactagtggatcccccgggctgcaggaattcgtctcacccctagaaaaaaaatatgccatccagaaaggtctattctgcaaaaaagaacacaccgtaagctcccgtcccggacggggaagacctcgtgctgccgccagatctaaccaaaccccgcgccctcctcaccgtccggcgagctacggactcagcagatcaccgtcgctcgagttgtacctgaaggcgcgcccgtggaaccggccgcgagataagggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgctttcaaatttgttgtcgaggcggtggctctcttcaagtcctacttcggtggagcttttgatgaagacgctatcaggaataactttgttttgatatatgaacttcttgatgagatcatgggattttggttatcctcaaaacctgtcacctggaaattttgaagtcgtatataactcaagaaagtgttccggtcaccatttttcctcaaagccctcagaagagcctggttcaaatgcgactcttcaagtcactgggcgctgtttggttgganaantagagggacntgtggtacaanaagaatgaagttttcttggaacatagtttgagagtgtaacccctctagcccttccaaaaggaag

SEQ ID NO: 88177 - protein, 133 aa, Zea mays
  misc_feature: Ceres CLONE 1575414
MPVAASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMGFWLSSKPVTWKF

SEQ ID NO: 88178 - DNA, 865 bp, Zea mays
  misc_feature: Ceres CLONE 1575417
  misc_feature: Encodes the peptide sequence at SEQ ID NO. 88179
  misc_feature (557)..(557): n is a, c, t, g, unknown, or other
  misc_feature (568)..(568): n is a, c, t, g, unknown, or other
  misc_feature (651)..(651): n is a, c, t, g, unknown, or other
aagctggagctccccgcggtggcggccgctctagaactagtggatcccccgggctgcaggaattcgtctcacccctagaaaaaaccagtccaccacacctcgatccccgcaccgcccagccggccgcccgcatccaccgcacaaaaccctaggcatggccccaccctaaaccccttgctccccacctcgtatggtcgtcgtccccttctccctccgcattgcgcgaaaccccatccgcctccgccttcttccggtctccgctgctcgcttcacccgtctcgccatgtcgaccacgccgccggcggcggctaccatatccgtcgagtatgccaagtccgggcgctcaatctgcaaggggtgcagcggggtcatcgcctccggggcgctccgcctcggcgcctctgcgcgcgacccccgtggcttcggcgccaccaagtggtaccacgtctcctgcttaccctcctcgtcgtacccgctcggccccatcgggagtatcaaggggttcgactccattaaggaccatgatcgtgcggaattgcgagaactagagaagatcntaaaagagacnatactgcagtcagccctccggaagaaaacacgtcaaagaaaagcagggatcagatgttttcccctgcggagggggtgcagatnatgtaacagtctcctgttgagtatgcgaagtctggtcgctctacctgcaaaggctgcagtgagaatattgcaaaagtggccctccgccttggtggctccttttcctgatccccgtggctaccaaaatactaagtgggaccaaggttgtggggctcccctacatcatccataccatttatttccaatgtcaaatccggaaggggttggattcaat

SEQ ID NO: 88179 - protein, 194 aa, Zea mays
  misc_feature: Ceres CLONE 1575417
  misc_feature (14)..(90): Pfam Name: zf-PARP Pfam Description: Poly(ADP-ribose) polymerase and DNA-Ligase Zn-finger region
  misc_feature: SWISSPROT Homolog: EC 2.4.2.30 NAD(+) ADP-ribosyltransferase
  misc_feature (92)..(92): Xaa is any aa, unknown, or other
  misc_feature (123)..(123): Xaa is any aa, unknown, or other
MSTTPPAAATISVEYAKSGRSICKGCSGVIASGALRLGASARDPRGFGATKWYHVSCLPSSSYPLGPIGSIKGFDSIKDHDRAELRELEKIXKETILQSALRKKTRQRKAGIRCFPLRRGCRXCNSLLLSMRSLVALPAKAAVRILQKWPSALVAPFPDPRGYQNTKWDQGCGAPLHHPYHLFPMSNPEGVGFN

SEQ ID NO: 88180 - DNA, 941 bp, Zea mays
  misc_feature: Ceres CLONE 1575418
  misc_feature: Encodes the peptide sequence at SEQ ID NO. 88181
ccccgcggtggcggccgctctagaactagtggatcccccgggctgcaggaattcgtctcacccctagaaaaaagcacacctagtacttgtttgagcccgttcactaatacactttcccattacatgacacaatctcgcagccgtaattacctacaaatctcgcgctgcggacgcacatcagacgccgcctcgactcctacccactctgtaccaccagtggagaaccaccaccgtcccgctcctccttcctctatacttcaacgtcttgatttacataattatccatctccacacctgataatacatgcgtcggtgtccttgccgcatcaatcgtttcactctctcgcaaaacctagcttgtttcaagcactctttgttgacatgtctctcataagaattgaaggataccttgctgctctccataaactggtgtggtactgggaagcacacgcacttagtgtcgaaacttagaatgtgcgatatgtttataatccctattgaaggtttatatcttctacttctctgaatcgatcagaggaatatctcttgaagatctagacactgtgaggctcctctcccagctcgtgactttaatactccccttcattggatgagggagagtatgttgtgaccagcattgtgagattatatatgctttcaatgaagccatatctcttgggaacaagaaaatgtaacagcgcgacttgtaagacactgttgtgagatggagagcctatagaaaagcactcatgctgacgatgctaacactatcagtgaagccacgatctcccccaagaaatggctactcaactgaactaattggggatgaaaaatgaaacttgtcaagaagatctcatttattctggtcaacatgatttagaactttcgggaattagcaccgtgctctggattggggaatgacccttcttgaactctttgtt

SEQ ID NO: 88181 - protein, 29 aa, Zea mays
  misc_feature: Ceres CLONE 1575418
MSLIRIEGYLAALHKLVWYWEAHALSVET

SEQ ID NO: 88182 - DNA, 947 bp, Zea mays
  misc_feature: Ceres CLONE 1575420
  misc_feature: Encodes the peptide sequence at SEQ ID NO. 88183
agctcaccgcggtggcggccgctctagaactagtggatcccccgggctgcaggaattcgtctcacccctagaaaacgcctcccaacctcctctgcttctgagatctctccccacctcccggtccgctagcagatagcgggggccagagagatcgagatccggaggcgctagcgccacccatcagcgtctgcggcaatggcgggcacggtgacggtcccggggtcgtcgaaaccctccacgccgctgctcaaggacgagctcgacatcgtgatcccgacgatccgcaacctcgacttcctcgagatgtggaggcccttcttccagccctaccacctcatcatcgtgcaggacggcgacccgaccaagaccatcgaggtgcccgagggcttcgactacgagctctacaaccgcaacgacatcaaccgcatcctcgggcccaaggcctcctgcatatccttctaggactccgcctgccgctgcttcggctacatggtctccaagaagaagtacatctacaccatcgacgacgactgcttcgtatgccttctgccctcttttgcctctcccggtttcgtatcccccattccgcggggatccaaaccaaggcggggtcttgaaacccgatttttcattcctccattccgcgtgaatcccaagggaagccggggtctggaccccggaacgggggcaaattaattggattgggcccattccccccggaccaatttggttttaaacctggcggggcaaacccttttacccccagggaatttgtggggggaaaccccccccctttgggaatcccggggcctttaaaaacgggggggggcaaaagaaaacccgtggcccccccccccccaagagaaaaaggggggggggccccctcccacggcgggggtttcaaatatactcccccccctcccttagggggagaaaataatggcccc

SEQ ID NO: 88183 - protein, 88 aa, Zea mays
  misc_feature: Ceres CLONE 1575420
MAGTVTVPGSSKPSTPLLKDELDIVIPTIRNLDFLEMWRPFFQPYHLIIVQDGDPTKTIEVPEGFDYELYNRNDINRILGPKASCISF

SEQ ID NO: 88184 - DNA, 950 bp, Zea mays
  misc_feature: Ceres CLONE 1575422
  misc_feature: Translation starting site: 443
  misc_feature: SWISSPROT Homolog: EC 2.7.4.14 Cytidylate kinase
  misc_feature (515)..(515): n is a, c, t, g, unknown, or other
ggagctccccgcggtggcggccgctctagaactagtggatcccccgggctgcaggaattcgtctcacacctagaaaaacccgcctccctcctccgttcctcactttccaatttccgtctccaccctccgcggtccgcgccgcggaccgcggtcaccactcaccagcagcgctgcagcgccacgccgccactccagtcccccaccgaccacttgccgattgccgttgccgcgtcggcgttgctggatcctcaagcagaccgcccggacccgggaacccgcccgcgcgcttattaataacggccacctcgttcccccgcccgccccgaaggccgagggaagtgtacgcgcctagcgaccaccataaattcgttccacgcctacctcctgccctcgcccgtgctctcagatctcgcgcgcgccccgcaaagggtaactttgagccatgggcacagttgtggatgctccagcagttgtggctgaagaggtcactgaaaacatgttgggtggtaagaaangtacagttgtatttgttctaggtggtcctggaagtggaaaatgcacacagtgtgccaacattgtgggacactttggattccccatcttagtgctggagatcttttgcgtgcagagattaaatctggctctgagaagggaaccttgattgaaacctgataaaggagggaaagattgtccatcagaggggactataaagccgttgccggagggaatgataaaaaagaaaatgacaaattcctgatcgacggtattcaaggaatgaggagatcctgcagcattggagaaggttacaaaatttcccccggatttggggctttcttggacggttcgaaaaaaaaaagagaaaacgtcccttggggagccaatcgggaaaaagatgatggaaacattgaaacttccaaaaagggtccaaaccctgggtgaggaaagttggc

SEQ ID NO: 88185 - DNA, 864 bp, Zea mays
  misc_feature: Ceres CLONE 1575423
  misc_feature: Encodes the peptide sequence at SEQ ID NO. 88186
ctccccgcggtggcggccgctctagaactagtggatcccccgggctgcaggaattcgtctcacccctagaaaaagcgtagtcttgttcatcttcgatctcctccatctcccttcatcctctctctcgctgtttgaggagaactgcctgcccctgctccctcttccgctcctccccgcgccccgctcgccatccccagacttcatttcaggccgggatggacgactacgcccgggagatgatggagctcaagacgctcgtcacccgcaccctcgagaagaagggcgtcctcgccaagattagggctgagctaagagcaagcgtgtttgaagccattgaagaggaggatcgggtggagaatgatgatggagggaaccctgctttgcttggtagctgtaatgaccgagctaagcaactgcatgcttcaccttcaggtaggttactaactgcacttgtatgcgaatacttggagtgggcgcaactaagtcacacaatgaaagtttacttgccagagtgtaacctgcccaaggacttctggaagaatgaactgaaagacttctctaacaaaagtggagctgaagggagcaggagtgctgaaagtggtcaatgcttttagatgttctcgaaagttatctgaaatatgaggtttatctcttgcctgatcattacagaagcaaaatcatccttttggttccttatgttttcaattaagaaaaaaggggaaagttctggtggatggggccaattcttttgtccatgaaaacggggtagcctgtatggataagggaaaaatccctagctttgcggcccacttgtcagttctagcggtttaggcctacccatttggccccttttttcttccctgt

SEQ ID NO: 88186 - protein, 132 aa, Zea mays
  misc_feature: Ceres CLONE 1575423
MDDYAREMMELKTLVTRTLEKKGVLAKIRAELRASVFEAIEEEDRVENDDGGNPALLGSCNDRAKQLHASPSGRLLTALVCEYLEWAQLSHTMKVYLPECNLPKDFWKNELKDFSNKSGAEGSRSAESGQCF

SEQ ID NO: 88187 - DNA, 1019 bp, Zea mays
  misc_feature: Ceres CLONE 1575426
  misc_feature: Encodes the peptide sequence at SEQ ID NO. 88188
ctccccgcggtggcggccgctctagaactagtggatcccccgggctgcaggaattcgtctcacccctagaaaaagagcaccagaggcagcgacacgatcgctagcgcacgcacgtaagcacgttgtcagaagctcaagtttgaagaagcaccagcgcctgatcgatggcggcccacgctctcctctcctgccggcagctgctgggccgccccgtgcagtcggccgtctctaggtcgtcggcgaggaaggcgcccttcgtcgtcagggccagctccagccctccagccaagcaaggcgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccattgctgggacgcggtggggcgccatcgcccccagagatcgtccggaaagatgggcttcattccccgtcagagtacccggtcttccatgggttcaaagaagggcggtcattcccctcccggtgggtcaccttacaacttaccggggtccgaattccttaaaacgacttctttcgttccttcaaacattggggggcctcatggggggcttgtcgccccatatacatccttcccgtctcttccttggtaccgggatacaaaccccgggggccctccatagtggcaaaagctagttattttcctctcggcgcgtgcgaataattatccctcccgcccgggttcccagggctaaccacgttcctaacccgggggggtgtttctcttataccacacctgtttcggtgttctgtgaatgaccctactaaggggaatgtatatgttcctctaggccccattggaatcttaaaatgggccggccgccgcagtgcctcccaactccctgttcttttataccaggggcctgcttacgccgattgtgacctttttcttatcct

SEQ ID NO: 88188 - protein, 197 aa, Zea mays
  misc_feature: Ceres CLONE 1575426
  misc_feature (55)..(175): Pfam Name: Chloroa_b-bind Pfam Description: Chlorophyll A-B binding protein
MAAHALLSCRQLLGRPVQSAVSRSSARKAPFVVRASSSPPAKQGADRQLWFASKQSLSYLDGTLPGDYGFDPLGLSDPEGTGGFIEPKWLAYGEVINGRYAIAGTRWGAIAPRDRPERWASFPVRVPGLPWVQRRAVIPLPVGHLTTYRGPNSLKRLLSFLQTLGGLMGGLSPHIHPSRLFLGTGIQTPGALHSGKS

SEQ ID NO: 88189 - DNA, 954 bp, Zea mays
  misc_feature: Ceres CLONE 1575427
  misc_feature: Encodes the peptide sequence at SEQ ID NO. 88190
ggagctccccgcggtggcggccgctctagaactagtggatcccccgggctgcaggaattcgtctcacccctagaaaaaattcccattctaccaccgacccgtcccgtcccactgcctgcctgcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctcctcccctgcgccgctcctcgcgggcgctgcgcgcttcccctccgcgctcgactccgtctgatcgcgcgaccgcgacccctccacctcgctcctcgaggccttcagcgtcctgggacgccgccgtcggctgcccccgcgtccgcgccaagctcgccgccgcggggctggtgctgggcccgggcctgccgctgccgagtgcgagcgccagcgccagcgctaactgcaccgcggaggaccctgcggcggcgtccgtcagctgcggcgccgcgtggcgcgtacccgctaggggcgaggacctggcagcgcgacacgtcggggtgctcgtcaagggctggacctggatccctgacgcgctcgaacgcgtctacacctgcccctgacgggttagctgcttctggaacaagtctgccgccgccctcgaacgtcccgacgcgctgctcttggggggggcaacgcctccggcgccacctttaaaaggttatgatgccggttttcccccgcctatgcagcttaaagcaagtgtggtattcgggccccctgccccacgagaatgaagggtttgccccttccctggttccccgggtctgtggggccatttggtagccaacggggttttgagggcaattttggtccgattacc

SEQ ID NO: 88190 - protein, 53 aa, Zea mays
  misc_feature: Ceres CLONE 1575427
MLFPKRINYVAPMLASAAILLLLLSGYFELPSISSPAPLLAGAARFPSALDSV

SEQ ID NO: 88191 - DNA, 990 bp, Zea mays
  misc_feature: Ceres CLONE 1575428
  misc_feature: Encodes the peptide sequence at SEQ ID NO. 88192
  misc_feature (491)..(491): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (911)..(911): n is a, c, t, g, unknown, or other
ctggagctccccgcggtggcggccgctctagaactagtggatcccccgggctgcaggaattcgtctcacccctagaaaaaatgcgttactgtaccaatggctccccacctcctggccgtggccgtggccgtggcggccatcatcgccaccgtctcgttgctggcgcccggcgccgctgcctacccgtggccagtttgtgggacgagcaacgacttcgagcccaacagcacataccaggccaacctcaacctcctcgccgccatgctgcccaacaacgtgtccgcatccccggtcctctacgccaccgccgtcgtctgcgccgtcccggagcaagtctggtgcatgggactctgccgcggcgacgccaacgccagcagctgcctcgcctgcctcatccaggcgttccatgacctgcccaacgactgctcctacaacatggacgcccgcatctactacgacccctgcacccctcactaactccgacgtccacnaccctcgccgtacgacgaacaccggccggacgaaccatgtcgttaaacatcaacaacaaaagcccaaggtcaccttcggacccgggccccgtttccgaagggcttctttgcccgccctttttaaagccaccccgagaaaaaggcccgggttccgaatccaaccgggggattttcccccgcggggggggggcgaaaccccaattttttaccggggggtttccccaaagggtttacccccctgggccattgacaccccgaacaaaaaaccggggccgtttgcccaaaggctccccccggccnnntattaacannnnnnngtggggggggtccaaaaaaatgaggaggaggggggttggggaaacatcccccggggggaaaaaaaccccccctttttaaaagggggnnnaaggatgggggcgnggtcattacccccgcgccgggggggaggaagaggaaaaaaaaaaccgggtctcccggggtttttttgggccccacaccc

SEQ ID NO: 88192 - protein, 126 aa, Zea mays
  misc_feature: Ceres CLONE 1575428
  misc_feature (80)..(125): Pfam Name: DUF26 Pfam Description: Domain of unknown function DUF26
MAPHLLAVAVAVAAIIATVSLLAPGAAAYPWPVCGTSNDFEPNSTYQANLNLLAAMLPNNVSASPVLYATAVVCAVPEQVWCMGLCRGDANASSCLACLIQAFHDLPNDCSYNMDARIYYDPCTPH

SEQ ID NO: 88193 - DNA, 954 bp, Zea mays
  misc_feature: Ceres CLONE 1575429
  misc_feature: Encodes the peptide sequence at SEQ ID NO. 88194
  misc_feature (511)..(511): n is a, c, t, g, unknown, or other
ctggagctccccgcggtggcggccgctctagaactagtggatcccccgggctgcaggaattcgtctcacccctagaaaaaaaccggccagggccagtctctacatcgaacacttcgttcagactgcggcggcggccatggcctctgctgcagggtctgaggaggcgtgcagggagatccgccgcacgtgcggcgcgccgcggcgcctgggcctcctgctggctccgcggagccccgccgagaggcagcatatcagggcggcgtaccgtgccaggttcggagaggacctcgccgcgacgctgcacgggaccctggcggcccccaacaccaaccaggtggacgagctctccaagctgctctacctgtgggcgctggagccggcggaacgggacgcgatcgtggcgcgcgaggcggtcgagggcggcgtgaccacggccggctaccgcgccctcatcgaggtgttcacgccccggaagcaggaccagctcttcttcaccgaggaggcctacacngtcatgttcaggaggagcctggacacgacatggccaccgagccgtctcaccctttacactgggtacgtgccccgtccttccttttctctttcgcttcccttcactggcgcggcccggtgatggggtcagaacacctgacttaacaaccgtcccgtcctttggtcccaacaggggtggctggtttcgcgggctcccgtaggttcgcccacggaagaacttggcaaaaattgggaaaaatggcccccagggaggctcccaaacccaaaaaaaggggccccggggccggtgtccggtcccctggccaaaaggcttttactcccaaaggttcccaaaggagaacccccaccccggggggggcttttaaccccaacacactattggggggtgtcccccgggggcaaaaaaaacagggggggggatataaaagcccccatatctttttg

SEQ ID NO: 88194 - protein, 164 aa, Zea mays
  misc_feature: Ceres CLONE 1575429
MASAAGSEEACREIRRTCGAPRRLGLLLAPRSPAERQHIRAAYRARFGEDLAATLHGTLAAPNTNQVDELSKLLYLWALEPAERDAIVAREAVEGGVTTAGYRALIEVFTPRKQDQLFFTEEAYTVMFRRSLDTTWPPSRLTLYTGYVPRPSFSLSLPFTGAAR

SEQ ID NO: 88195 - DNA, 974 bp, Zea mays
  misc_feature: Ceres CLONE 1575431
  misc_feature: Translation starting site: 214
aagctggagctccccgcggtggcggccgctctagaactagtggatcccccgggctgcaggaattcgtctcacccctagaaaaattcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgagagcaccacgcagttcaggaagctgctctccatagagcgtagtcccccaattgaagaggtgatcagcacatgagtcgtgccccgattcattgagttccttacacgtgaggaccatccacaactccagtttgagggtgcatgggcgctcaccaacattgcatcaggcacatcagaaaacactaaagtggtggtttgaaaatggtgctgtgcccatctttgttaagctcctcaaactcaatagcgaggatgttcgtgaacaggctgtatgggcttaaggaaatgttgctggtgaactcccaaaagcgccgtgatctggtgcaaggccaatggtggggctatgccccttgacggccacagcttaaagaagcttggctaagcctctccaatgctcgagaatgcccacatggaaccctattcaaaattcctgccggtgggaaacccacaacccgaaccttgggattaaggtcaaaacaatgatttggccag

SEQ ID NO: 88196 - DNA, 821 bp, Zea mays
  misc_feature: Ceres CLONE 1575434
  misc_feature (85)..(85): n is a, c, t, g, unknown, or other
  misc_feature (257)..(257): n is a, c, t, g, unknown, or other
  misc_feature (307)..(307): n is a, c, t, g, unknown, or other
  misc_feature (337)..(337): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (343)..(343): n is a, c, t, g, unknown, or other
  misc_feature (344)..(344): n is a, c, t, g, unknown, or other
  misc_feature (346)..(346): n is a, c, t, g, unknown, or other
  misc_feature (347)..(347): n is a, c, t, g, unknown, or other
tggagctccccgcggtggcggccgctctagactagtggatcccccgggctgcaggaattcgtctcacccctatgaaaaagcggcntttaccctgcctggcctcctgtcctgccctgcctttccccccgcatgctctcgctcgctctctcgttctcgtggttctcccgagtcccgtgccgctcgagtgcgccgtctgcgtctctagtggcgacgactgggcgaccgccgccgccgccctacgcaaggtgcccagctcntcattttcggtccctttcgcggacacgagcacccgcatggatatatgttngtcacgcatgagggcaatgcctgaatccangnnntnntnngaaaaaacccttcccctttttccccccttaatgggggggtaatccaaaggggactagaggcctagtaaaatgtcctgaaggaaatcctaattttgggaaatggaacttaaagggaatggttccttccaggtttccctccgagaaaaaattggggccccccctttgtctgccctggggaaaaaattttaaaatttggccccctggtattctttgtaaaaacccccccccttttctgaggtttaaaaaaaccccccaaaattttgttgggaaaaaaccccccaaaaaaaaaaaaaaaaaaaccggggggcccccgggggtgtttatatcccccccggaggaaaaaaaacccccctttttttcccccggggggaggggggggagaaaatttccttccccccccccctttcttatagagagggggggggggggggtggggggggggcgccctaaaacccccccccccttgtgtggttt

SEQ ID NO: 88197 - DNA, 1009 bp, Zea mays
  misc_feature: Ceres CLONE 1575435
  misc_feature (425)..(425): n is a, c, t, g, unknown, or other
ctggagctcaccgcggtggcggccgctctagaactagtggatcccccgggctgcaggaattcgtctcacccctagaaaaaatgcctccagtgtccagtccagagtccaggctccaggactaccaccacttcgtctcgtcctcacacctcactccaccacctctgccttgcaaagccttccaccgatccgccgcctcgtccgcgcgctcgcaggcagcagtgtggactacccgccccatactccatcccctactcgaaggacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttangtgtagaggaagagaaggatttgctaatattgcgttggcagggacctccaaagtagtgctgggatgtatcgcctttggggattttctggggggaagggcgtcttcccccacgtcccgttcatgcctgttggggcggacggctgggtccctccttggtgctatgctaaagggtcctgttcccgcgtcatctccccggaaggacccgtacccccggattgaccttcccgatcaatgggccgtgcctttgggaaaaaagggccgtcaagattcttcccttgaaagggcaaaactggttaaatacccccgggaacctggccccccggggaaaaaaaaagagcacaaaggaaccggcctcttcaaatctgcacccggtcccccctttgccagggccctttccccaaagaaacagagggttggtggcccccccccaggttccccccaggggggtgggggaaaaaaaacggggcccaaaagctttttcttgggggcctgggcaaaaggtaaaaaaagaggcttctgccgcccccctatggaaccccccaaaaattttttttttgtggaagggggggaacacctttcgcccc

SEQ ID NO: 88198 - DNA, 820 bp, Zea mays
  misc_feature: Ceres CLONE 1575436
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
nnnnnnnnnnnnnnnnnnnnnnnnnnnnnnnnnnnnnnnnnnnnnnnnnnnnnnnnggggnnnnnnnnnnnnttttcaagctggactccccgcgtggcggccgctctagaatagtggatcccccgggcctgcagggaattcgtctcaccccttagaaaaaactcacgccatgcgactcttcacggcctcggcgtgacacctgcctgccccgtgcccttccagatccgacgaacgacactgacgagcaaaacaaacccaaccgacccaagcgagacgaccagaccgcgattgctagataagctagttctgcggcaacaacgcggggtgagacggctatagggtgctgctccaccgtttcttgcaccaatcccctgggggctttcaacatttcatcccccatggtttccggccctccccggaggccccccggcgaggtttttcccccctggcctttgggaaaatttgggccaaaaggggccccctttccggttcctcccccttttgggcccccccgggcccccccccccctttttccttttgggggtgcccccggggggggaaatttttttttccgagggggggggggcccccctttttttcccccccccctatatttttttccccccccggggaggagaaaccccccccccaaggggggtttttttttttctcccccccccggggggggttccccccttgggggggggggaaaaatatttttctccccccccccccgagggggggtttttttttttttccccccacaaaaaaaaaggggggccccccccctttttgaaggaaaaaatatcccccccggggg

SEQ ID NO: 88199 - DNA, 1004 bp, Zea mays
  misc_feature: Ceres CLONE 1575440
  misc_feature: Encodes the peptide sequence at SEQ ID NO. 88200
  misc_feature (522)..(522): n is a, c, t, g, unknown, or other
atatgctggagctccccgcggtggcggccgctctagaactagtggatcccccgggctgcaggaattcgtctgacacctttaaataatcaagcccactctttgttaactaagaattccctcatagccgccgccgccgccgccgccgccgccgccgctcatctctccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgcccgatgcgcgaagaagttccagtctgctgcttactccatctgcgcaaatgagccattctgatatccccttttggctccncggtccaagaagttaggatttccttttctgaaaactgcaatttctttacaattcccccgtggccggctggttttcccggaaattcgacccattttcccatgtttttggtccctggaggtcctcccctcccccattttccagggggtttgggttcttggacccaccttgcccaaagggggtgtgtctttccgggcgggggggtggcccccccgggcccccaaattatgggggtttgaggggctttataaaacgccctcttaaatacacttttttcgggagccccttttttttgtgaccccccgggggaggggtttggggggcccccccaaggcccaaaatggcccttttttggatttggggggggcaaaattggggccacacccccacagggttttgtccccctttttcccccaaaaagggggggttcccccccgaaaattgataaaagggggggcccccccccctccacattaaggaatgaa

SEQ ID NO: 88200 - protein, 50 aa, Zea mays
  misc_feature: Ceres CLONE 1575440
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPARCAKKFQSAAYSICANEPF

SEQ ID NO: 88201 - DNA, 1007 bp, Zea mays
  misc_feature: Ceres CLONE 1575441
  misc_feature: Translation starting site: 218
ctggagctccccgcggtggcggccgctctagaactagtggatcccccgggctgcaggaattcgtctcacccctagaaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaagacgggtcttgtttgcacggccagaaagccctggatcgctgttggcatgcgcaacgtggactacaagcgtgccgagcatttccgaggtcgaacttttctcccttcagaacatccttgagatcgacaaagaaaagatggtttgccaaggtcaacgccccttggcaacatgggggcaaataaccagagctccttgcccaatgaactttgcccccttggggttgttccccaatctcaacaacctcccgggtgggggggggtgattaacgggttacgggatccgaggggagctcccacccctttggccttttttcccaaacgtttttccccaatgggaggttttccctacaaaaggcgggggttctaaaaccccccggagaaacaggtccccggaccttttttgggggttcccccgggcccgagaaaaacggggggttccctggtccccgggagaaataaaggtttccccccgaaggaggtccgggacgccccccccccccccccgaggggggggtaaaaagatatcccccgcgccccggaatttttttgt

SEQ ID NO: 88202 - DNA, 918 bp, Zea mays
  misc_feature: Ceres CLONE 1575444
  misc_feature: Encodes the peptide sequence at SEQ ID NO. 88203
  misc_feature (788)..(788): n is a, c, t, g, unknown, or other
  misc_feature (892)..(892): n is a, c, t, g, unknown, or other
  misc_feature (893)..(893): n is a, c, t, g, unknown, or other
ctggagctccccgcggtggcggccgctctagaactagtggatcccccgggctgcaggaattcgtctcacccctagaaaaactttccatctgccgttcgcccagcgtgttctccctctagtgcggcaactgggcgaccgccgccgccgcttactccgggtgcccaggcattcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctacaagaaattctgaacctgtgaattctgctactactgttttgccagctcaagggggctcttctactttagaaatccttctgattttccagtcaatcaccagatgtttctgggtgcagtgaagtgctcattcaactgatctggtatcacaagtccntaatagcactgccctttatgaacctcctgagaaaatgaaaaagaaggtcaaatcaactcggatgataaactttgagagctagggtcacagtactgaatttgatnngtgattgctgaatagtcaggagtca

SEQ ID NO: 88203 - protein, 174 aa, Zea mays
  misc_feature: Ceres CLONE 1575444
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWAALHLQETAATLLTASLATRNSEPVNSATTVLPAQGGSSTLEILLIFQSITRCFWVQ

SEQ ID NO: 88204 - DNA, 951 bp, Zea mays
  misc_feature: Ceres CLONE 1575457
  misc_feature: Encodes the peptide sequence at SEQ ID NO. 88205
  misc_feature (677)..(677): n is a, c, t, g, unknown, or other
  misc_feature (691)..(691): n is a, c, t, g, unknown, or other
  misc_feature (699)..(699): n is a, c, t, g, unknown, or other
  misc_feature (752)..(752): n is a, c, t, g, unknown, or other
  misc_feature (890)..(890): n is a, c, t, g, unknown, or other
  misc_feature (951)..(951): n is a, c, t, g, unknown, or other
ctggagctccccgcggtggcggccgctctagaactagtggatcccccgggctgcaggaattcgtctcacccctagaaaaaaggagatcagagccccggcgaggtcgcaccgcaccagccatcgtctccttccttccttcctatactaccatccaaccagctgcccagcgcaaggttacctgcccgacatccgacaagccagtccatccggctgcgagcaaaggtctgagatgggttccgtagacgcggcgatcgcggtgccagtgccggcggcggaggagaaggcggtggaggagaaggcggtggtgttccgttccaagctccccgacatcgagatcgacagcagcatggcactgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgcccgcccgctgggcgcccgcatcaccacggccaacccgttctacaccccgcacgatgtgcaccgccaggcggaagctggcggcgccaggctcatcgtgaccgatgcctgcgccngtggagaaagtgcnggaagtcncggcggatcggggcatccccgtggtcaccgtcacgggcgcttctacggctgcntggagttcggcgagctgatcccggctatgtagctgtagccgtacccctaatccaccccgacaactcgtcgcgctggcctattcctcggaacaccggtttgccaatggggtcatggtaaccaccgaagctcatcacaangttcccccacaggttgatgcgaaacccaatcttgttcttcccaaggacaactggtgctggn

SEQ ID NO: 88205 - protein, 184 aa, Zea mays
  misc_feature: Ceres CLONE 1575457
  misc_feature: SWISSPROT Homolog: EC 6.2.1.12 4-coumarate--CoA ligase
  misc_feature (150)..(150): Xaa is any aa, unknown, or other
  misc_feature (157)..(157): Xaa is any aa, unknown, or other
  misc_feature (175)..(175): Xaa is any aa, unknown, or other
MGSVDAAIAVPVPAAEEKAVEEKAVVFRSKLPDIEIDSSMALHTYCFGKMGEVAERACLIDGLTGASYTYAEVESLSRRAASGLRAMGVGKGDVVMSLLRNCPEFAFTFLGARPLGARITTANPFYTPHDVHRQAEAGGARLIVTDACAXGESAGSXGGSGHPRGHRHGRFYGCXEFGELIPAM

SEQ ID NO: 88206 - DNA, 976 bp, Zea mays
  misc_feature: Ceres CLONE 1575461
  misc_feature: Translation starting site: 595
  misc_feature (752)..(752): n is a, c, t, g, unknown, or other
  misc_feature (862)..(862): n is a, c, t, g, unknown, or other
  misc_feature (907)..(907): n is a, c, t, g, unknown, or other
aagctggagctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggccaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcgttggaagtgctgaactttgctgctcttaacacaagcctatccgggtgatgtattcaaaccgtgatccaagcagccgcaggagtggatctgctaacattttcataaaaaatcttgacaagacaatagacaataaaacccttcatgagaccttttcttcatttggtaccattctctcatgtaaggtagccgtggatgaagcaggccnatcaaaggggcttggttttgttcagtatgacaaagaagaagctgcgcagaacgctataaaaagtcttaacggggatgctataaatgataagcctgtttttgtttggaccntttgtcgcaagcaagaaaagaatcattcttttgacagacaaattnaacaatgtctttggtgaaaaatggtctgagtctacccaaagaggatacctcaaatcttgggggataggg

SEQ ID NO: 88207 - DNA, 956 bp, Zea mays
  misc_feature: Ceres CLONE 1575465
  misc_feature: Translation starting site: 168
ggagctccccgcggtggcggccgctctagaactagtggatcccccgggctgcaggaattcgtctcacccctagaaaaaatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgtcaagacgccgtcctctcggcccaccttgcttgacgagagccgcgcggggtcgtcgtcgtcgtcccccgatgacgagtcgtccctcgcgtccgtgccgctcggccccggcacgtccgtcggcgtggggcactacgtcaccccgcatgggcctcggcacgccgggcaagtcgtacgtcatggtcgtgggacccggggtcctcgctcacctgggtccagtgctccccctgggtcttgttttggcaaccccagttcgggcccggggttaaaccccaaggggtcagctccttaccctccgtttctcggtccccgaaaaattggagggacctcccaccggccaggttaaccccgccctcgggttccccccaaaggtttggtttttcgggccgggttggggaaagccccttctccgggggggttttgaaaaagaacactgtgtttttggtccccccgggggcccattttttatggggggggaaaaaaaagaggggcccttcgggggggggggggggctcccccgcgcgggaaaaaaaattgt

SEQ ID NO: 88208 - DNA, 951 bp, Zea mays
  misc_feature: Ceres CLONE 1575466
  misc_feature: Translation starting site: 267
  misc_feature (698)..(698): n is a, c, t, g, unknown, or other
  misc_feature (728)..(728): n is a, c, t, g, unknown, or other
  misc_feature (732)..(732): n is a, c, t, g, unknown, or other
  misc_feature (821)..(821): n is a, c, t, g, unknown, or other
  misc_feature (881)..(881): n is a, c, t, g, unknown, or other
ggagctccccgcggtggcggccgctctagaactagtggatcccccgggctgcaggaattcgtctcacccctagaaaaacccctctccccacatcgggcagcctcccccctctctctcaccgctcaggtcaggccaggcccggcgggagagagatccggcgagagacgcggcctcttgctcccctcaacccccttaaagaagcgcatagaagcttcggaaggtgcccctccggcggctcgaagggaggggaggggacgccgcggacaatgacggcgatggaagccgccgtcgacgctatgctcgccgccgcgagccgtgccttcacgagcacctttgccatcgccatccagatccaggggtgcatgatctgtttagtccttgctctcgggtgggcggctgcttcaattgtcagaaaaggggttataaagaacatgaggcgcaacattgtagatggaaatagttttgcatttctttgtgacaacatagatgagcttgagcactctgttcaggagaatttacctagagtctctgtagtcatgcctttgaagggctttggcgaacataatttgcaaaattggcgaactcagattacatcactttatggtgggccactggaattcttgtttatcgtcgagagcaaagatgatcctgcttatcatgctgtttcccgtttgatcacagagtacaaggacaatctnggagcaaaggtgggtcgttgctgggttgtncacnacctgtagccagaaaattcacatcaattgatcggtgtttgaaagatgacaaggataccaagtatgtattgtttcctgatgatgatgtgnagctgcatctggggactatcggatctctcacaaagaaatggagaagatcctgagaaattnatacaactggatatcccctgactttacttctggcagttgggcagcttatgcaatatgattacacatgctt

SEQ ID NO: 88209 - DNA, 919 bp, Zea mays
  misc_feature: Ceres CLONE 1575468
  misc_feature: Encodes the peptide sequence at SEQ ID NO. 88210
  misc_feature (877)..(877): n is a, c, t, g, unknown, or other
ctggagctccccgcggtggcggccgctctagaactagtggatcccccgggctgcaggaattcgtctcacccctagaaaaagagtacgagtgcctggtaatttatgttcaccaacagggacagacagctgcaagtgattgctgcagcggccccgcaagcgagagagaacttttctacccaaacaaacagtccaatccaattcctagggcaatccggcgaacgtgtgcgtgtgtatatacatgcacagagccgcgatccgccgaaggcctcgctcctaccggcacacggattcccactttcgagaccgcttctcacgctgttgctgtactatcctactgcccggaccctgaggaaggcccgaaggaagaaaggaaggaaagcggtgatggcccacgagaccgtgcaggaagatgcccccaagcttcgctgcggggcagacgcgcccggccgaatggagagcgacccagcatcaagtggctcatccggatgatccacgagaaggaagtgtacatcaacaccgcgctccactaggacctcgcgaagccgaatatggaggccttcctccacgacatatcacttacaaagccctcgtgcagatgtgcgctcaatgcgctcaagaactgtatgaagcccgagaatgtacctgcgggaataactacattaccgtaatccgcccagatcgtggcagagcccgacggcgtattactcatcatctcagcctggcactgcactgtctactctctatcgaccagtcactggagcatcagcagctcgtatcgctgctgtctgaagcatcagaactacgccagctacctcggactgtcagcaaggtgactaccgagatgctagcactcctgcatatagctgcgaggaaacantccatagacacgccactctggacagaaatggtatagactgca

SEQ ID NO: 88210 - protein, 39 aa, Zea mays
  misc_feature: Ceres CLONE 1575468
  misc_feature: SWISSPROT Homolog: EC 1.2.1.3 Aldehyde dehydrogenase (NAD(+))
MEAFLHDISLTKPSCRCALNALKNCMKPENVPAGITTLP

SEQ ID NO: 88211 - DNA, 914 bp, Zea mays
  misc_feature: Ceres CLONE 1575474
  misc_feature: Encodes the peptide sequence at SEQ ID NO. 88212
  misc_feature (752)..(752): n is a, c, t, g, unknown, or other
  misc_feature (753)..(753): n is a, c, t, g, unknown, or other
  misc_feature (814)..(814): n is a, c, t, g, unknown, or other
  misc_feature (842)..(842): n is a, c, t, g, unknown, or other
ggagctccccgcggtggcggccgctctagaactagtggatcccccgggctgcaggaattcgtctcacccctagaaaaaaactccttcctccccacctccacattctcccatccgccctgctttcccctccaaccatgccgtcttcttcctccccgagatctcgccatgcctgctctcccgcctcctgctagctagcctagcctagccagctgcgtgcgtgcgtgcgtgatcgtttcctgcatgcgatatcaccaacgcttcgctggaagaaggcgtcgtcacagacagggatcgaagaataaaagttgatcgatggtagagagcaagagctagctagggtttgggagctgaggctaggaccgaacgtacgtacgtgctgccattgttcatgacgccggcaaggcgcgtgccgccggcggcgatgatcggccggaatggcttcgcgtttgggtcctcgtcggcgctgtctttaagccaggctgacctcctagacagccatcagctgcagcaagcgttccagcagcagctcttcgatcagatcccgaccaccaccacagtggacgatagcagcgacaacctcatccatggccgctctgacacgctggtagatgagttcgagagcaagtcctgcagcgagaatcccgacggaacctctggtgacgatggcctggaggaagaccctatcagcggccgatacagagaagcgataccaccgcacacccagcaccagatccaagagatgggagcgttcnntcaggagtgccggcacccggacgaacagcagcgaaagagctgagccggtatgctcgcctcnagccgctgcaggtcaagttttgggtccngaacaagcgcacccgatgaagaacagcccgagcggccgagacgcgcagctgcgcgcgaagacgacagctgcg

SEQ ID NO: 88212 - protein, 135 aa, Zea mays
  misc_feature: Ceres CLONE 1575474
  misc_feature (122)..(122): Xaa is any aa, unknown, or other
MTPARRVPPAAMIGRNGFAFGSSSALSLSQADLLDSHQLQQAFQQQLFDQIPTTTTVDDSSDNLIHGRSDTLVDEFESKSCSENPDGTSGDDGLEEDPISGRYREAIPPHTQHQIQEMGAFXQECRHPDEQQRKS

SEQ ID NO: 88213 - DNA, 946 bp, Zea mays
  misc_feature: Ceres CLONE 1575476
  misc_feature: Encodes the peptide sequence at SEQ ID NO. 88214
tcccgcggtggcggccgctctataactgtggatcccccgggctgcatgaattcgtctcacccctagaaaaatccccaacccacgcatctgccctccggtctctctcacactacactgggatataagcccagtccacgagatctcccgtagaccagtggctagtgtagggaaggaacgaatcagagccctatcctagcgacaggccatggaagatcgccatgatgatgatgggcgaaggcttgagcgtgccgccttggtccctccacgtccccgtgagcggcgtctacgtcggtctcggcggctgctgcgacgagatgacgccgtacctgctggcggagctgcgtgattacctgtcgtgcatggtcgccggctccgcctaggaggacaaccaggaggcggcggccatggcctcgggcgtggacggctactgctgccacgatttccgcatgtacgagttcaaggtcactgaggtgctgccgcgcgcgcttgcacgaatggatcgagtgccccgtctcacacccagaggagtatgctccgttcgcgcgacaagcgcaggatacactactcgggcgccctcctgccgggacttccccaaggggggggtgcaggatcgggggacaacttgctaattaaatccaagggttaattccaagtgttgcttccccaccgggggactaaggcaaccaggcctagcaggggggaaaagacctgcctccggcgctttttgcttttctcctcccaaccccggaacaacctggggggtgctcccggccaaccctgggagtatttttgcgccaaacccaacgggccccgggggcaatttccggaggtcttccacggggttcaagtgcccccccggggatttcaaaatccccccaaaaagaaatccgtgccctttaagggaaacacctctttgtggccaatcaaaattccccccgtagtgtgg

SEQ ID NO: 88214 - protein, 53 aa, Zea mays
  misc_feature: Ceres CLONE 1575476
MMMMGEGLSVPPWSLHVPVSGVYVGLGGCCDEMTPYLLAELRDYLSCMVAGSA

SEQ ID NO: 88215 - DNA, 1048 bp, Zea mays
  misc_feature: Ceres CLONE 1575477
  misc_feature: Encodes the peptide sequence at SEQ ID NO. 88216
ctggagctccccgcggtggcggccgctctagaactagtggatcccccgggctgcaggaattcgtctcacccctagaaaaaaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatgacattggggtgatgagtggagcggccatgtacatcaagaaggacctgaatatcacggacgtgcagctggaggtcctgatcgggatcctcagtctctactcgctgttcggatccttcgctggcgcgcggacgtccgacaggatcggacaccgcttgaccgtcgtgttcgcccgctgtcatcttcttcgtgggctcgttgctcatgggtttcgccctcaactacgggatgctcatggcggggccgcttcttggccgggaattcggtgtggggctacggggggcatgattcgcccccgttgtaccccgggccaaaatctccgccggcgggggtcccgggggctttccctgaaccacccttccccggagggggtttattcaaacaatcgggcattcccggccttgggcatacctggtgcccacatttcggggttttggggggggcttccccggtttccaaccttggggtgtgggggcgttattggcctccccatttggggggaaattttcctttccgggcccgtggttcggcgctccctggggggttcctggaatggacccaaaaattccgcccccgggtgggggggggtctctaaaaggggcgcccctctcggtgaacccacgggggttggtcctataaagaaaaacccctcgcccccccccaataagaagagcctcacaaagggggttgtgccaaaattaaagggccgcgggcggggaattcccaaagggcgcctcgagggaggaaggtggccccccttcccacaaatatgaaaaagagcgccggtgtttattttctg

SEQ ID NO: 88216 - protein, 293 aa, Zea mays
  misc_feature: Ceres CLONE 1575477
MASDELAKAVEPRKKGNVKYASICAILASMASVILGYDIGVMSGAAMYIKKDLNITDVQLEVLIGILSLYSLFGSFAGARTSDRIGHRLTVVFARCHLLRGLVAHGFRPQLRDAHGGAASWPGIRCGATGGMIRPRCTPGQNLRRRGSRGLSLNHPSPEGVYSNNRAFPALGIPGAHISGFWGGLPRFPTLGCGGVIGLPIWGEIFLSGPVVRRSLGGSWNGPKNSAPGWGGVSKRGAPLGEPTGVGPIKKNPSPPPNKKSLTKGVVPKLKGRGRGIPKGRLEGGRWPPFPQI

SEQ ID NO: 88217 - DNA, 940 bp, Zea mays
  misc_feature: Ceres CLONE 1575478
  misc_feature: Encodes the peptide sequence at SEQ ID NO. 88218
  misc_feature (736)..(736): n is a, c, t, g, unknown, or other
ggagctccccgcggtggcggccgctctagaactagtggatcccccgggctgcaggaattcgtctcacccctagaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcggtgatcggcctgctcctcgccaacccgcgggtccaggtcgtgcccagagccaccttcaagctcctgagcaagctcgtcttcgcgctcttcctcccctgcctcatcttcgtccacctcggcaagtcggtcaccatagacaacgtcctgcactggtggttcatccccgtcaacgtgctcatcagcactgccatcgggggcgcccttgggtacatcgtggccctgatctgccgcccgccgccgcacctgttccggntttacggtgatcatgaccggggtcggtaacacggggtacctcccgatcgcgatcatcgggtcagtctgccacaccacgaccaccccttcggccctgggtgcgacacctgggcatcggctatgtctcgttcccgcagtggggtgccggcattcttgtgtacccctggtctacccatgatggatccaccgatgccagcctacgaaa

SEQ ID NO: 88218 - protein, 122 aa, Zea mays
  misc_feature: Ceres CLONE 1575478
  misc_feature (114)..(114): Xaa is any aa, unknown, or other
MVWSMDPQVTVHGDWVSAVVPLMKLLCLAVIGLLLANPRVQVVPRATFKLLSKLVFALFLPCLIFVHLGKSVTIDNVLHWWFIPVNVLISTAIGGALGYIVALICRPPPHLFRXYGDHDRGR

SEQ ID NO: 88219 - DNA, 876 bp, Zea mays
  misc_feature: Ceres CLONE 1575481
  misc_feature: Encodes the peptide sequence at SEQ ID NO. 88220
  misc_feature (746)..(746): n is a, c, t, g, unknown, or other
  misc_feature (792)..(792): n is a, c, t, g, unknown, or other
  misc_feature (798)..(798): n is a, c, t, g, unknown, or other
  misc_feature (799)..(799): n is a, c, t, g, unknown, or other
ctggagctccccgcggtggcggccgctctagaactagtggatcccccgggtctgcaggaattcgtctcacccctagaaaaactcacgcaaccaccactgcctcacgcaaccacctcagcccggtccacctctaccaccggccacccactgcctccacccccgccctagatcaccaccgcactctcaggcgcaagaacgagctcaccaggcaaagtcacggcggcgacctccgccttccaggtctcgcccttgctggcgcgcgcctctgctcaccacccagcgccgcgtcttccttctccagtccggtcgctggccgaccgccagcgcggctccgggccctgctttccgcacgcccaagcctgcgcgctccggacgcacctctcctgctcttctgggcttgggaaagagaagaaaccagcataaaaacactagatctgtgaaggatttgaggaagaaaccaaaccgaaaccctagtgacgatgctagagttcggacctcgctctgagtcgaaacgaccagagaccgctgccttccctccccattttcctttcccatgaaccaagcagcgtatgagctttccatccctcctcatttacctatcccacctctcatatcccgttatccaaacggcacctcagggtactgcaatccagaagcaggggccctggcctcagcgcacctggatggcagggctggaggagttgaagaagaactacaacccttgctggtcgatgacctggacagangtggcgccagtaccagggtgcccttaccagaagatactgcgatccntaccanngttctgatggtggactgttaaaattactagtagatccctggggtgagtataaatcaatgagcatgctttcataaaca

SEQ ID NO: 88220 - protein, 78 aa, Zea mays
  misc_feature: Ceres CLONE 1575481
  misc_feature (59)..(59): Xaa is any aa, unknown, or other
  misc_feature (75)..(75): Xaa is any aa, unknown, or other
  misc_feature (77)..(77): Xaa is any aa, unknown, or other
MSFPSLLIYLSHLSYPVIQTAPQGTAIQKQGPWPQRTWMAGLEELKKNYNPCWSMTWTXVAPVPGCPYQKILRSXPXF

SEQ ID NO: 88221 - DNA, 930 bp, Zea mays
  misc_feature: Ceres CLONE 1575484
  misc_feature: Encodes the peptide sequence at SEQ ID NO. 88222
  misc_feature (494)..(494): n is a, c, t, g, unknown, or other
ctggagctccccgcggtggcggccgctctagaactagtggatcccccgggctgcaggaattcgtctcaccccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccgggcgctggtatggatcccnatggcctcaaaactggaggccttttgctcccgaccatcgagaggcggtgcacgtcgcctccatccgtcattgtcatcggcggtggcatcctcgggcgttgcagctgcccgtgcccttctccaattcttcatttaaggggacggttttgaaaccgaaaaatccgattggcggccgctttcatccggaaacccgtttggaagcccatttgattggggaccctctggctacccggggggggaaaggaaacccctgggccccttgaaaaccttttgggggggggggttcccccccaacgagaataaacccccttctggttaaaataaattaaaaaccctcccctctttaaaagggggataacgggcccccaagagaaccccccaaatgggggaaaaccccagaaatatttttaaaaaagggaaatacccccactaaacaa

SEQ ID NO: 88222 - protein, 52 aa, Zea mays
  misc_feature: Ceres CLONE 1575484
  misc_feature (4)..(4): Xaa is any aa, unknown, or other
MDPXGLKTGGLLLPTIERRCTSPPSVIVIGGGILGRCSCPCPSPILHLRGRF

SEQ ID NO: 88223 - DNA, 909 bp, Zea mays
  misc_feature: Ceres CLONE 1575491
  misc_feature: Encodes the peptide sequence at SEQ ID NO. 88224
aagctggagctccccgcggtggcggccgctctagaactagtggatcccccgggctgcaggaattcgtctcacccctagaaaaaaaatccttgctgccctccctcctccgacgccggaggccatcagaaacgcgcgtgcgcgcccgcgcaaccaccaccacaacccctttcctatccacgttctccggcctcgctcctactgtctcccggtcggccgcccaccggccatcgttcgtctcatcccatgggtgttggggcgatggaagcctcttctccggccggcgacgacgtcggcggcacgggcatcgaggacctcccggcggacgtcctcgccctcgtgctccgccgcctggatggcgcgtcgctggcggcggtcggctgcgcgagctccggcctccgcagcctcgccaccgacccggccacgtggcgggcgctctgcttcgccatgtggccctccgtccgcgacctgccctgcacaggccgcgtcgacggcggtcaccgggcgctcttcgccgacgccttccccttcccgtgctcggtctcccctcccacgccgccgcagcccctgcccgcgcgcctcgtgtcggccgtcgacctgcgccacgcgggggtctgcgtcctgtcgcgcgtcgtggagacggacgccgcctccgactggttcctgggcgcgccgttccgcgtcgacgcgctgctgcaggagggcttcacgtcgccggacgccgcggcgatcgcgccggacgacctcgagctcagctgggtcctcttcgacccggccaccggccgcgcgctcaacgcgtccagccgccgcgccgtggacgtcgtacgcaagtggctcacgggggaacacgtggcgcgctccgccttggtttttgggggggcggggtctggctataaaccgccgttacgtgga

SEQ ID NO: 88224 - protein, 222 aa, Zea mays
  misc_feature: Ceres CLONE 1575491
  misc_feature (19)..(66): Pfam Name: F-box Pfam Description: F-box domain
MGVGAMEASSPAGDDVGGTGIEDLPADVLALVLRRLDGASLAAVGCASSGLRSLATDPATWRALCFAMWPSVRDLPCTGRVDGGHRALFADAFPFPCSVSPPTPPQPLPARLVSAVDLRHAGVCVLSRVVETDAASDWFLGAPFRVDALLQEGFTSPDAAAIAPDDLELSWVLFDPATGRALNASSRRAVDVVRKWLTGEHVARSALVFGGAGSGYKPPLRG

SEQ ID NO: 88225 - DNA, 952 bp, Zea mays
  misc_feature: Ceres CLONE 1575492
  misc_feature (291)..(291): n is a, c, t, g, unknown, or other
  misc_feature (694)..(694): n is a, c, t, g, unknown, or other
ctggagctccccgcggtggcggccgctctagaactagtggatcccccgggctgcaggaattcgtctcacccctagaaaaaaacgacaacctccacctcgtcttcccctcctccgcgctcccgtcatctacaactctcgctcccacccacgagtcccaccggccaccgccaccaccaccagtctatcccctcgccatttgttttcctccccgtgcatgaaaacctgaaacaaaaaccccaccctccatccctgaagcaatcccctccagcgcggcgatggccaaggcgctanttttctcctccctcctcccgggctgtcgggggctgccggagggacccgaaaccccccaagcccaatctgctcccacccttccggtttgcggcccggccgggggccccccccccccctttgaaaaggaaaggggggcctttcaagggtcccaaaccccctgggggggcccccccttttgggcccccctgtaagaccccccaaaagggggcctttaaaacacccccttaaaaacccgggtgtcccccccgggggggggggggggggaaaaaaaaggaaaaagtgtggggggggggaaaaaaaaaaaaaaaagggggggggggggggggttttttccccaaaaaaccccccaaaaagagggggccccaaagaagaggggcaaaaaaaaggggtattttttttcttncccccaagtgggggggaaaaaacccccccgggggggggggggggggataattttcgcgcgccccccactttctttgtgggggggggggatatctctccccccccccaaaaaaaggggggggggggaccccccccgcggggggaaattttatttcccccccccacttatatatatccctcaaaaaaaaaaggccccccccccaaaaaaaagaagatgatggggaggccggcctttttaataaagagggggtggggcccc

SEQ ID NO: 88226 - DNA, 924 bp, Zea mays
  misc_feature: Ceres CLONE 1575498
  misc_feature: Translation starting site: 305
  misc_feature: SWISSPROT Homolog: EC 2.3.1.158 Phospholipid:diacylglycerol acyltransferase
  misc_feature (476)..(476): n is a, c, t, g, unknown, or other
ctggagctccccgcggtggcggccgctctagaactagtggatcccccgggctgcaggaattcgtctcacccctagaaaaaatgtcaccgaggccatcacggggccgctcccggacccgcccggggtcaagctgcagaaggaggggctgcgagttaagcaccccgtcgtcttcgtcccgggcatcgtcaccgggggcctggagttatgggaggggcaccactgcgccgaggggctcttccgcaagcggctatggggcggcacatttggtgacgtatacaagagacctctatgctgggtcgaacatatgtcattggacaatgaaactggattagacaaacctggaataagggtcaggccggtcacaggcctggttgcagcagactattttgtccctggatattttgtttgggctgtcttaattgccaatttagcacgtattggatatgaagaaaagaccatgtacatggctgcatatngattggaggttatctttccagaacactgaggtccgtgatcaaactttgagcagaataaagagcaacattgaactcatggtagcaacaaatggggaaatagggggggggtggtgatcccacactgccatgggggtcctctattttttgcattttatgaaatgggtcgaagcactcctcccatgggggggtggcggtgtcccagactggtgtgagaagcatattaagctgtaatgaaatatggagaccttttctaggagttctaaggctgttgctggcctttctcatctgagccaaagatgtgccgtgctagactatcgctctgatgtctggactcgatttcctgggctcaaacttgcgccattgatggttgacccgacatgggatcacatgcatgattcctaaggtgggaccattggggaaaactgatggtcccaaaaatgcttgatgt

SEQ ID NO: 88227 - DNA, 955 bp, Zea mays
  misc_feature: Ceres CLONE 1575501
  misc_feature: Encodes the peptide sequence at SEQ ID NO. 88228
  misc_feature (758)..(758): n is a, c, t, g, unknown, or other
  misc_feature (827)..(827): n is a, c, t, g, unknown, or other
  misc_feature (828)..(828): n is a, c, t, g, unknown, or other
  misc_feature (835)..(835): n is a, c, t, g, unknown, or other
ctggagctccccgcggtggcggccgctctagaactagtggatcccccgggctgcaggaattcgtctcacccctagaaaaagcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacaagcggcgcaaggcggaactgaagaagattactcgngtcgtggagaaagggtacactccttcccaacagcctgccggggacgctcattaccaagggatgcaggcnncgcggcngctgcacggcgtgctgtgcaaatcattgcggaacgtcttggccaggcccaggcggcggcaccggcctgctgggctgcctgagcggtcccggggggacaaaggccgccctcctaaactaaa

SEQ ID NO: 88228 - protein, 274 aa, Zea mays
  misc_feature: Ceres CLONE 1575501
  misc_feature: SWISSPROT Homolog: EC 1.14.13.93 (+)-abscisic acid 8'-hydroxylase
  misc_feature (233)..(233): Xaa is any aa, unknown, or other
  misc_feature (235)..(235): Xaa is any aa, unknown, or other
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDKRRKAELKKITRVVEKGYTPSQQPAGDAHYQGMQAXRXLHGVLCKSLRNVLARPRRRHRPAGLPERSRGDKGRPPKL

SEQ ID NO: 88229 - DNA, 882 bp, Zea mays
  misc_feature: Ceres CLONE 1575502
  misc_feature: Encodes the peptide sequence at SEQ ID NO. 88230
ctggagctcaccgcggtggcggccgctctagaactagtggatcccccgggctgcaggaattcgtctcacccctagaaaaagacaccacacgacactccccgagcacacacgccgcaatagcaccacccccagacccaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaagagttcgggggagatgccaaggtctgggacccgcgagaggtcgtcatcatccccgaccactacatcttcaccagcgacgagcgcgccaaccgcaacgtcgatatcctcagggacttctgtctggagcagaacatcaagtacttctatgatatcaaagacctcagcgatttcagggctaatccaaactacaaggttggctgccacatggcacttgctcaggaaggcactgccgaacaggcgaaggtcctcctggtactgaatcccaaacgtgcaatgctgggacctttggtcatttggaacca

SEQ ID NO: 88230 - protein, 208 aa, Zea mays
  misc_feature: Ceres CLONE 1575502
  misc_feature: SWISSPROT Homolog: EC 4.2.1.33 3-isopropylmalate dehydratase
MASSISAAAKASAAFAQKKELAAPAPHRAGSSRRTKPCRVRAVASPARTPRAPSSTGSVKTAMTMTEKILARASERAALEPGENVWVDIDVLMTHDVCGPGTIGIFKKEFGGDAKVWDPREVVIIPDHYIFTSDERANRNVDILRDFCLEQNIKYFYDIKDLSDFRANPNYKVGCHMALAQEGTAEQAKVLLVLNPKRAMLGPLVIWN

SEQ ID NO: 88231 - DNA, 789 bp, Zea mays
  misc_feature: Ceres CLONE 1575504
  misc_feature: Encodes the peptide sequence at SEQ ID NO. 88232
ccccgcggtggcggccgctctagaactagtggatcccccgggctgcaggaattcgtctcacccctagaaaaaagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgacgggctccctcaccgccgcgctcctcgccccgctggccgagctgcgggtcctcagcctcaagtccaacgccctcacaggccccatcccggatgccctcccgcgcgcgctcccaaaaatctcaagctgctgtacctcgccgactaccggctccagggcgcgtccccgcaccctcgcatggtcaccggggcacgtcatcgtctctccggaaaccgctcaagggcagaatccgccctccttggcgccctgcaagcctgacttggtgtcctcgaacggaactgttacggggccctggccccctggggaaaccaaccccaggggctaaagtttgggaaaccccggtggggggaaaacccccctccccccccccagggtaaaaccttttttcccccaaaggggggccttggggggccccctaacctccccttgttttgggggggccaaaccccgcccctttac

SEQ ID NO: 88232 - protein, 189 aa, Zea mays
  misc_feature: Ceres CLONE 1575504
MPRRAGAAWPCFLLLHIIAHLHLAVNAADADALLTFKSSLDRSDRLPWRPDTAPAFCASWPGVRQCAPAGRVTKLVLEGLNLTGSLTAALLAPLAELRVLSLKSNALTGPIPDALPRALPKISSCCTSPTTGSRARPRTLAWSPGHVIVSPETAQGQNPPSLAPCKPDLVSSNGTVTGPWPPGETNPRG

SEQ ID NO: 88233 - DNA, 936 bp, Zea mays
  misc_feature: Ceres CLONE 1575506
  misc_feature: Translation starting site: 218
ctggagctccccgcggtggcggccgctctagaactagtggatcccccgggctgcaggaattcgtctcacccctagaaaaagctcgctcgcccgccaccgagagacgacactctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcagaagaagccatgcgggaggccctggagagatcatagcacagttgatgctgatgggcttcatctcgctgctcctcggcgtggggcagacgcccatctcctagatatgcatccccggcaatgctggcagcatcatgctgccgtgcaagccgcctaaagcgccgccgcccccgccgacaacaaaagagcgaacggccgccggaaaccctctgggacccgccgtaccctggatacaatgagcccgggcaccaccgcgttttcctcgccggggggggccccggaaaaaaattctgggggggccaaggggaagggggcccttattcccttggggggggtccccaaggggaaattttttttttggggggggggggggtccattttttataagggcccccccgggggggggggggggcccaaaggggaatgggaaaaaggggattggaacccacccccggggaaccgttgcaaaaacccctttgggggggggtacacaaaaaatttttttagaggggccgggggccctaaaccccggggggaaaggggggggggcttctgagggttccccccccaaaaaagggaatc

SEQ ID NO: 88234 - DNA, 919 bp, Zea mays
  misc_feature: Ceres CLONE 1575508
  misc_feature: Encodes the peptide sequence at SEQ ID NO. 88235
ctggagctccccgcggtggcggccgctctaggactctgggatcccgcggggtgtactgatgcttctccacggctacaaaacggagctggacagcctcgcctcccagtccgcgagcgacatgcggagcgcgtgctgcgtctcgtccggcggcgtgtacaacaacgtgctattcttccccgtcgtgcatatgctcaaggaccggtacccctgcgtgctggtggacctggtggcgtcggcaaggggtaagcaggtgtacgatatgtgcaagaacgtcaggtacgctaacgtctatgaccccgacgacgactggccggagcccgccgaatacacgcacatgctcggcgtcctaaaggtacgtacatacttgtgctgctattccatatggaacatttcctctgccccacgagctaattctcgtcttgcatgttattgtcaccgacagactacgtactatgatccgatcatctccacgacgctggcggggatcgggcacgcgctcttccttttcatgtcgtcggcgcgccacaacgtcggctacgtgtgacccaaccttcacatcgtcaggtgcgtgcctctgttctcacaagatgggtcaaggctccgacttaccatctccccgaacgggctggtaccacattgtgaaagccctccattttgcacaacgatttggttggctatttttttcatttgcgttcccgtgcgattatgcaactgtgccccgtcttaagaaatgctggattggattagacaagccggtgaaaaaactttcccaaatatcgaaacaaccggttggggtggccaatcccaaaaactaaggggcgttcggggaggaaaaaaaaaccccccccgccttgaaaaaggaaattcagtgtctttagggaatcccctttgtatctgggccaaattgtagggggagtgg

SEQ ID NO: 88235 - protein, 161 aa, Zea mays
  misc_feature: Ceres CLONE 1575508
MLLHGYKTELDSLASQSASDMRSACCVSSGGVYNNVLFFPVVHMLKDRYPCVLVDLVASARGKQVYDMCKNVRYANVYDPDDDWPEPAEYTHMLGVLKVRTYLCCYSIWNISSAPRANSRLACYCHRQTTYYDPIISTTLAGIGHALFLFMSSARHNVGYV

SEQ ID NO: 88236 - DNA, 877 bp, Zea mays
  misc_feature: Ceres CLONE 1575509
  misc_feature: Encodes the peptide sequence at SEQ ID NO. 88237
ctggagctccccgcggtggcggccgctctagaactagtggatcccccgggctgcaggaattcgtctcacccctagaaaaatcctccccagttccaacttccaagaacccgtgaagtgaagtgaggaggtcggcggaaccggaacccaggcgatacgagatgatcgcaaacggcctccgcaaatccagtgctgcctcctcccaggttagcaagctggtgaaatacattgctagtgctggaagcttgcaaggggggcacagtttatcagagccgtctgccagacattacagctctgaaccttcacttcaggcgacagaagaaaatgggtttaaggggcacagcatgctggctccattcacagcgggatggcagagcactgatgtacacccattggttatagagagatcagagggttcttatgtctatgacagcaatgggaagaagtatattgatgctcttgcaggactgtggtgcacagctttaggtgggtatgagcctcgactagtcaaagcggcaactgagcaattaaacaaattacggttctacattcccttttggaaccgtacaaccaaaccctcattggatcctccaattgattttccaacaggttcccccaaaggaaaaggggaagggggtcttccaaaataggggttcaaaaccaatgaccccccggttaaaaggggggggattttaaaatagccgggggagggcccaaaaaaaaaattttttggccccacaaaacccccggggaaacccttgttgggcgggtgtttagggggggcccgcctcttcaaaattttttttcccccccctttttggggtgaaaaaaaagccccccaaggggggggctccttctcctaagaaaaaaaaaaaaaaaa

SEQ ID NO: 88237 - protein, 162 aa, Zea mays
  misc_feature: Ceres CLONE 1575509
  misc_feature: SWISSPROT Homolog: EC 2.6.1.62 Adenosylmethionine--8-amino-7-oxononanoate transaminase
MIANGLRKSSAASSQVSKLVKYIASAGSLQGGHSLSEPSARHYSSEPSLQATEENGFKGHSMLAPFTAGWQSTDVHPLVIERSEGSYVYDSNGKKYIDALAGLWCTALGGYEPRLVKAATEQLNKLRFYIPFWNRTTKPSLDPPIDFPTGSPKGKGEGGLPK

SEQ ID NO: 88238 - DNA, 877 bp, Zea mays
  misc_feature: Ceres CLONE 1575510
  misc_feature: Encodes the peptide sequence at SEQ ID NO. 88239
  misc_feature (865)..(865): n is a, c, t, g, unknown, or other
ctggagctcaccgcggtggcggccgctctagaactagtggatcccccgggctgcaggaattcgtctcacccctagaaaaagtcttatcccctcgcccctcctcccctccgacgctccccccacctcacctcgtcaaccccctccttggatagggttagagttcccccggcacgagcgcgagccatggcctccttcacctgctcccatgtcggcgctgcggctgcgggcggaacctcgcccttcctcggctaccggcggcggagcggccccgggggcgccatcccgtcgagctccctcttcgtgggccggcggttggcaggcggtgcggatgcgcgcgccctctcgcggggtccgcgggggctccgcgctgcgggtcacgtgcgagaaggtggtggggatcaacctaggcaccaccaactccgcggtcgccgccatggagggcggcaagccgaccgtcatcaccaacgccaagggagcgcgcacaactccctccgtagtggcgtacaccaagacaggcgagcgcctggtggggcagatcgctaagcgccatgcggccgtgaaccccgagaacgccttcttctatgtcaagcgcttcatcggacgctagatgtctgatgtcgacgacgaggacaagcatgtctcgaacggcgttgtcagagacgagaacgggctcgtcaaactcgactgccccgctattggcaaacagtttgctgaccgagagatctctgctcatgttgtagagacattggtgatgaggcatctaagattcttagtgagaaactacacaagcggtgattaccgtacagcttactcgatgatgccataggacagcagctaagatgcgggcggatgaaaggacggaaangtctctaattta

SEQ ID NO: 88239 - protein, 133 aa, Zea mays
  misc_feature: Ceres CLONE 1575510
MSALRLRAEPRPSSATGGGAAPGAPSRRAPSSWAGGWQAVRMRAPSRGVRGGSALRVTCEKVVGINLGTTNSAVAAMEGGKPTVITNAKGARTTPSVVAYTKTGERLVGQIAKRHAAVNPENAFFYVKRFIGR

SEQ ID NO: 88240 - DNA, 897 bp, Zea mays
  misc_feature: Ceres CLONE 1575511
  misc_feature: Encodes the peptide sequence at SEQ ID NO. 88241
ctggagctccccgcggtggcggccgctctagaactagtggatcccccgggctgcaggaattcgtctcacccctagaaaaacatactggttcttgctccacagggtcagtctctccgccaagttcggactgcttgctccagctctgccctccttccgctcgcccgatacctccgcacttgttgatgaggactctcctcccctcagggtttgggcaacctaatgtccgggccaccctgatatccttgatactccttgagttgaagttaccaccgggcctcttggccagggcatcgcccatgccgatgggctggcacttactgagaatgacctggctgcccgcttgctcaagcctgactgtgtcatcgtcgaccactgcacgtacctgctgttgggagacggctgccaaatggagggtattgctaatgaagcttgctccttggctggacactggggtcttggcaagctgattgctttctacgatgacaaccacatttccatcgacggtgactcggagattgcattcacagaggacgtgagcacccgcttcgaggctcttgggtggcacacgatctgggttaagaatgggaacaccggatatgatgacatcctcgcagccattaaggtagcgaaggcagttactgacaagcccaccttgatcaaggtgactaccacgatcgtgttttggatctcccaacaatgccaactcatacagtgttcatggaagtgcactgggtgccatagaggttgtagctaccaggcagaaccttggatggccctacgacacattctttgtaccagaggacgtcaagagtcactggatgcgccacacaccgtgaggtgctgcacttgagggctgattggaaacgctagtttgcggattaccgacatgaagtatgt

SEQ ID NO: 88241 - protein, 147 aa, Zea mays
  misc_feature: Ceres CLONE 1575511
  misc_feature (1)..(143): Pfam Name: Transketolase_N Pfam Description: Transketolase, thiamine diphosphate binding domain
  misc_feature: SWISSPROT Homolog: EC 2.2.1.1 Transketolase
MEGIANEACSLAGHWGLGKLIAFYDDNHISIDGDSEIAFTEDVSTRFEALGWHTIWVKNGNTGYDDILAAIKVAKAVTDKPTLIKVTTTIVFWISQQCQLIQCSWKCTGCHRGCSYQAEPWMALRHILCTRGRQESLDAPHTVRCCT

SEQ ID NO: 88242 - DNA, 956 bp, Zea mays
  misc_feature: Ceres CLONE 1575512
  misc_feature: Encodes the peptide sequence at SEQ ID NO. 88243
  misc_feature (585)..(585): n is a, c, t, g, unknown, or other
  misc_feature (586)..(586): n is a, c, t, g, unknown, or other
  misc_feature (714)..(714): n is a, c, t, g, unknown, or other
acccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaatgagagcaccctccactggnntgtgcgtctcaggggcggcatgcagatatttgtgaagactctgactggcaagactatcacccttgaggtcgagtcctctgataccatcgacaatgtcaaggcaagatccaggacaaggaggcattccntccgaacagcagcggctcatttttgcgggaagcatctcgaagacgggcccaccctggcaactacaacatcagaaggaaagcacctccccctggggctcgcccccagggtgggctgcaaaattctctgaaaaaccttacggcgaaacaatcccccttgaggggggatccccggacccctcgcaaaggccagggttaatacccggaaaaggaaggggttcccccgaaacaggggggttcttttt

SEQ ID NO: 88243 - protein, 230 aa, Zea mays
  misc_feature: Ceres CLONE 1575512
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (146)..(146): Xaa is any aa, unknown, or other
  misc_feature (189)..(189): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQNESTLHWXVRLRGGMQIFVKTLTGKTITLEVESSDTIDNVKARSRTRRHSXRTAAAHFCGKHLEDGPTLATTTSEGKHLPLGLAPRVGCKIL

SEQ ID NO: 88244 - DNA, 908 bp, Zea mays
  misc_feature: Ceres CLONE 1575514
  misc_feature: Encodes the peptide sequence at SEQ ID NO. 88245
ctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcggcaaggttgtggacagtggccccaatgatcatatatttgttttctacagtgaccatggggggtcctggcgtccttggaatgcctacgtatcatatctctatggtgatgacctcgtagatgtcctgaaagagaagcatgctgccaggaactacaaaagcctggtcttttaccttgaagcatgcgatctaggaagcatcttgaaggcctcctgccgaattgacataatgtgtattgcgacaccgctcaattgcaaaagatagtaactgggggactaactgccctggcgagtccgagccctcc

SEQ ID NO: 88245 - protein, 234 aa, Zea mays
  misc_feature: Ceres CLONE 1575514
  misc_feature (49)..(232): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGKVVDSGPNDHIFVFYSDHGGSWRPWNAYVSYLYGDDLVDVLKEKHAARNYKSLVFYLEACDLGSILKASCRIDIMCIATPLNCKR

SEQ ID NO: 88246 - DNA, 917 bp, Zea mays
  misc_feature: Ceres CLONE 1575515
  misc_feature: Encodes the peptide sequence at SEQ ID NO. 88247
atagctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgacgtccacagggccaccgtcgaaatgcatccgtccgcgtacgtgcgggcgacaccgtcgctcctcggcgagcagggagaagacaccgagtgggtgacggtgaaacccggccggaaacagcccgcagaggacgactggatccacggcttctctccgtctgaattcaactcgtcggctacatgtccgaacccatggccagcagaagaaccctatctctgcacagcacccatcaagtatcacttcgccaactactctgcgaactacatcttctggtgcaaaggggaggatccggctgcagctcatcaaacaagcgcttcgacttcttcttcgccctctttaccggggggctcagcaacccgagaggtgatcacggtgtgcgaacccgattcttttaattaacccaaagggcccccgttttcgtcccccggcgaagggggcctcccacgaccagatgacggggacgtgggaacaccggctacgccccccaataaaagggacccccttcccgggaagggggcgccccttgttggcgtcccccggggcagccttcttttgtaagcacttgatatttgtttcgggcaacttggggaaaaggggaacgggaaccggccgaacaaataatccgggggtacaaaccccggggcgttccaccc

SEQ ID NO: 88247 - protein, 168 aa, Zea mays
  misc_feature: Ceres CLONE 1575515
MAVALLAALVASAAMFMLAGTASASPAEGIQPLSKIDVHRATVEMHPSAYVRATPSLLGEQGEDTEWVTVKPGRKQPAEDDWIHGFSPSEFNSSATCPNPWPAEEPYLCTAPIKYHFANYSANYIFWCKGEDPAAAHQTSASTSSSPSLPGGSATREVITVCEPDSFN

SEQ ID NO: 88248 - DNA, 875 bp, Zea mays
  misc_feature: Ceres CLONE 1575516
  misc_feature: Encodes the peptide sequence at SEQ ID NO. 88249
  misc_feature (512)..(512): n is a, c, t, g, unknown, or other
aaagctggagctcaccgcggtggcggccgctctagaactagtggatcccccgggctgcaggaattcgtctcacccctagaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaaggagccggatcgagtggagtcagctagctagatactccgtggtcgtcgtcgtcgttggacgtacgccagaagaaggagctagagaagaataccgtacagctgcttccaacatggcagctgcctcgtctgcccacctggtcggactcggcgacgggcagatgcagatgcagccgcagcagcagcaggcgccngctcctcctcttgtgaacacccgggcggcgccgccgcccaagaagaagcgggaaccacccgcagaaccctgacccgggagggaatcgcgccttccccccaaaacgctaatgggcaacaaacgggttcgggggggaaggggggcaaaaaggggttccaggggggaaaaaaaaacggggactggacccggggcgcgggaaaaaccggccggggaagcctgataccaaaaaaaccccccgggaaaacccgggggggggggtaaccgtgtccccggagccaaaaagggtggacccaaaacacccccccgggggcgggggggacaccccgggggaataaaaaaacatctccccccaaaccgcgagaga

SEQ ID NO: 88249 - protein, 50 aa, Zea mays
  misc_feature: Ceres CLONE 1575516
MAAASSAHLVGLGDGQMQMQPQQQQAPAPPLVNTRAAPPPKKKREPPAEP

SEQ ID NO: 88250 - DNA, 733 bp, Zea mays
  misc_feature: Ceres CLONE 1575517
  misc_feature: Encodes the peptide sequence at SEQ ID NO. 88251
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (644)..(644): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
caaagctggagctccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggacccgcatgtcggcgtgccgctgcctcaagagcctcgccaacagcgtcaagaagcgtcaacatggggcaccggtcgccacccttccccggggaaggggcggggggcccccctggggattccccccttcaggttggggcccccgggtgggaaaaaaaatattaggcttaatttttccaaaaacaccccacgctttttaaggcccccccccccaaggttggttttcccaaaaattctccccccccccgccccggggggcnnnngtntggtttttgtttaaacaccccccggcgggggggggggggagaaaaaaaaannnaaaaattttnnnccccccccctcgcggtttttgttt

SEQ ID NO: 88251 - protein, 166 aa, Zea mays
  misc_feature: Ceres CLONE 1575517
  misc_feature (161)..(161): Xaa is any aa, unknown, or other
  misc_feature (162)..(162): Xaa is any aa, unknown, or other
  misc_feature (163)..(163): Xaa is any aa, unknown, or other
MAAVLNSRKTAQAVVAVLVAAALLASSTSAAITCGQVGSSLAPCIPYATGRASALPASCCSGVKSLNSAARTSADPHVGVPLPQEPRQQRQEASTWGTGRHPSPGKGRGAPLGIPPFRLGPPGGKKNIRLNFSKNTPRFLRPPPPRLVFPKILPPPAPGGXXXVFV

SEQ ID NO: 88252 - DNA, 943 bp, Zea mays
  misc_feature: Ceres CLONE 1575518
  misc_feature: Translation starting site: 254
  misc_feature: Pfam Name: E2F_TDP Pfam Description: E2F/DP family winged-helix DNA-binding domain
  misc_feature (710)..(710): n is a, c, t, g, unknown, or other
  misc_feature (711)..(711): n is a, c, t, g, unknown, or other
  misc_feature (834)..(834): n is a, c, t, g, unknown, or other
  misc_feature (928)..(928): n is a, c, t, g, unknown, or other
ggagctccccgcggtggcggccgctctagaactagtggatcccccgggctgcaggaattcgtctcacccctagaaaaaccctcgtttctcgcaccccttcgtttccctcgttttcttccctcccttccccctaccccgcgcaaaccctcgcccgccgcctcctcctcctcagatcccagctccaggaccctgccgcccgcccgcgcccgcgaccgggcctccgatccgcgcacccgcgcctgccccgatccccatggcggcggcggccggtgacggggccggcgaggccagggcacgggcgctgctgcagcagcaccggccgtttgcgacgccgccaggggagtaccaccacttcggcgcgccttccgccgccaccgacgagatggtggaggcggttgtcctcaggacgccattgaaacggaaacataacgacagaacagaaaatgaagctgccgaatcaaatgactggatgagccctggatatgctaatgctggcagcagcccagttcctacacccccttcagggaaaggtttaaaagcatccaccaagcctaaggctacgaagggccagaaatctggtcctcagacccctttgggttttggttctccgggcaatccttctactcctgttggtggctgccgctatgatagctccctcgggctcttgacaaagaagtccctgaacttgctaaaggtgcacctgggggcanntgtgatctgaatatgctgcagaaactctagagtacagaaaaagcgtattatgacatcactaatgttcttgaaaggataggactgatagaaagaagcttaagaacacatccggttggaaggagntgacgactctcgacccggagaagtagtgatgatatgcccatttacaagcagattggatgctctcccctgcagaacgcatttggagaaccaatantgaatggcgtacgaa

SEQ ID NO: 88253 - DNA, 933 bp, Zea mays
  misc_feature: Ceres CLONE 1575519
  misc_feature: Encodes the peptide sequence at SEQ ID NO. 88254
  misc_feature (188)..(188): n is a, c, t, g, unknown, or other
  misc_feature (203)..(203): n is a, c, t, g, unknown, or other
  misc_feature (206)..(206): n is a, c, t, g, unknown, or other
ctggagctccccgcggtggcggccgctctagaactagtggatcccccgggctgcaggaattcgtctcacccctagaaaaagagcgcgatccagaggctggcgcacctgcgtcactcgctccacgctgccgcgatctcctctgacgtcgaagtcgcccgggggatgacacagggggaaggggtggtgtngggaggggtgaacanganctcggtgacttttgtgagggccgccagatggaggagcgccggctcgacacgccggcgatgaggagaatcagcgagtggattctttcactagagttcccaagcgatattaccatccaggttggggaggcgaccttcaacttgcacaagctcccgttggcacccaagtgcggctacataagggagcaggtgtcggggatcaatggctccagggtcacccacatcgacatcacgggcttgccgggcggcgccgcggcgttcgagctcgtcaccaaattctgctacggcgagaacttcgagctcacggaggacaacgtcgccctgctgcggtgcgccgccgagcccctggagatgaccgacgacgacagcatgggcgggaaccttggccggcacgaccgagtcctacctggaggccatggcgctgatgagcctcgcgggggcggtcacgtgtctccggatgtcggaagacctcctcccggtgtccgagaaggggaacctcgtcgggaagggcatcgacaccatcgcctacttcaccctgcaacacaggcaattaaaaaggtccaaaggaaatggcatggacttgtcgacgtccaaggccctcaaccaagaattggtgggctaaaatcctctcttcgctgtcgtaattaaaccttcccaaaaaatcttaattgcgccgaaggcaaggggttcaaagggttttgtttcctggaaaccatattaatgcggatat

SEQ ID NO: 88254 - protein, 205 aa, Zea mays
  misc_feature: Ceres CLONE 1575519
MEERRLDTPAMRRISEWILSLEFPSDITIQVGEATFNLHKLPLAPKCGYIREQVSGINGSRVTHIDITGLPGGAAAFELVTKFCYGENFELTEDNVALLRCAAEPLEMTDDDSMGGNLGRHDRVLPGGHGADEPRGGGHVSPDVGRPPPGVREGEPRREGHRHHRLLHPATQAIKKVQRKWHGLVDVQGPQPRIGGLKSSLRCRN

SEQ ID NO: 88255 - DNA, 889 bp, Zea mays
  misc_feature: Ceres CLONE 1575523
  misc_feature: Translation starting site: 182
  misc_feature (836)..(836): n is a, c, t, g, unknown, or other
ctggagctccccgcggtggcggccgctctagaactagtggatcccccgggctgcaggaattcgtctcacccctagaaaaatcggcgatctcggctggccgcctgggcttggccctcgccccgctcccgtctccggttccggcggccgagccagatttgctcgggtcttcgtgccatcgacgatgaaggacaagcgtggactcgaggacgccggcgactggcgccctgatgccaagaggccgcggcctccggctctggccagtgttattgttgaagcgctaaaggtggatagtctgcagaggctctgctcatcattggaaccaattcttcgtagagtagtcagtgaagaagtggagcgtgcactgggcataacttggccctgcaacaatcggtggaaggccttccccaaagagaattgaaggtccaaatggaagaactctgcaactcgaattccgaacaaggctgtcacttcccctttttactggaggaaaagttgaaggggagcagggagctgcaattcatgttgttttgtttgatgctggcactggctgtgttgtatcctctggaccagagtcgtctgccaaacttgacatcgctgttctagaaggtgatttctacaatgaacatgaggagggctggaccggagaaaactgtgacagtcacgttgtgtaagagcgtgagtgaaaccggcctattttgactggtgatctaaagccccactataagagggtgtggggacaattggggagcttacatcacagataactgtagctggattacgagtaggaattccgacttggcttgaagattgcctcacgattttgtgaagggtggccnccttcgtgaggaaaaaacagaacccttttggttaaggaccttggaggaaatgg

SEQ ID NO: 88256 - DNA, 1199 bp, Zea mays
  misc_feature: Ceres CLONE 1575524
  misc_feature: Encodes the peptide sequence at SEQ ID NO. 88257
  misc_feature (917)..(917): n is a, c, t, g, unknown, or other
acccgcggtggcggccgctctagaactagtggatcccccgggctgcaggaattcgtctcacccctagaaaaagacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttattccaggaccccagcttcttctttgtttccaaacctaaaaagtacagcaagatcttcaaaacccaccttctgggtttgcctttgcgccccccccccccaaccccggaagccagcacggttttttgcgtgttaaccaaagtccaccttgttaaaagccaactcaccccctgaaacaaaagaaatcttgaatcggggccggtggaattctcttttttcgcacaaaggggtgaaaaaaaaacctccccccttcaaataaaacacttccaaagtggcctcctttatttctcaaaaatcatatttgcccatcgctttatttttcccgaaaaggggggaagacgcctcttttgtgggaaaccaccatacctgcggtttatttgggagaatctcgagggccacctctccaatataaacaccgatttctccacacccccagtgagaaataaacctctgtctcctatttataagtggtgggatgtttgctaataaataatattctttcttgtgagtcacgtaagtgtcgataataaaacaccgcgtctcactgggtggaaaaatttacaatataaaattttaccctccctctcccgcctattagtaagagaggggttaaacatcntccctctctctctcaataatttatgcacgtgaggaagcatattcctatctttcttatggagcacgtaccgtgtttcacgcagtgttagttcttgaacgcggaatgatgataatacgtcctcaatttttgagtattgtaagagtgtaatacatcaccacatctttcggggcgagagccaccttccctattggttgtttataaaaatagctctcctgctcgtatatgaaaacagattcgccatccctatggataatacataacaacctatctatctagatttgg

SEQ ID NO: 88257 - protein, 103 aa, Zea mays
  misc_feature: Ceres CLONE 1575524
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSRTPASSLFPNLKSTARSSKPTFWVCLCAPPPQPRKPARFFAC

SEQ ID NO: 88258 - DNA, 931 bp, Zea mays
  misc_feature: Ceres CLONE 1575525
  misc_feature: Encodes the peptide sequence at SEQ ID NO. 88259
  misc_feature (680)..(680): n is a, c, t, g, unknown, or other
gctggagctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccacgtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcaaggctacccttggacgcatcataaatgttattggtgaaccgattgatgagaagggtgacatnaagacaaaccactcctccctattcatcgtgaagcccctggcctttgtgagcaggccactgagcagcaaattcttgttactgggatcaaagtcgtggatcctcctgccccctacaaaggggtggaaagattggcctctcggtggggcaggattgggtaaaactgtgccatcctggagtgatcaacatgtgcctaggcccaggggggttctctggggttccgggggtggagaacgtaccgtgaagtatgatct

SEQ ID NO: 88259 - protein, 263 aa, Zea mays
  misc_feature: Ceres CLONE 1575525
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (180)..(180): Xaa is any aa, unknown, or other
MASRRVVSSLLRSASRLRAASPAAPRPRAPPHRPSPAGYLFNRAAAYASSAAAQAAPATPPPATGKTGGGKITDEFTGAGAIGQVCHVIGAVVDVRFDEGLPPILTALEVLDNNIRLVLEVAQHLGENMVRTIAMDGTEGLVRGQRVLNTGSPITVPVGKATLGRIINVIGEPIDEKGDXKTNHSSLFIVKPLAFVSRPLSSKFLLLGSKSWILLPPTKGWKDWPLGGAGLGKTVPSWSDQHVPRPRGVLWGSGGGERTVKYD

SEQ ID NO: 88260 - DNA, 903 bp, Zea mays
  misc_feature: Ceres CLONE 1575526
  misc_feature: Encodes the peptide sequence at SEQ ID NO. 88261
  misc_feature (620)..(620): n is a, c, t, g, unknown, or other
  misc_feature (711)..(711): n is a, c, t, g, unknown, or other
  misc_feature (794)..(794): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaagtttctctttctccccaattcctccgccgtcccgtctgtccccttcggaaacccaatggcgtcgcccgacgacgagtccgcgcagccaccatcgaagcggccccgacgcgatgccgaacctgaggtggacgccgctgagccatcaccgcgcgtggtgctcaacccagcggactgcgatctcgacttcgatgtaggcgggggcggtctccgggggagcgcgcttcacgagggcggcttcgcctactgctggtccggcgcgcgcgcgacggtgggcgccaggggcggcgggcggtactgcttcgggtgcagaatcgtcgctgagcagccgggtggagatggatcccacgacctccggggagcgccacctctgccgcattggggtctcgagaggggatgatcccgtaggtgcgctcggggagtcccagcacagcttcgggttcgggggcacggggaagttctcccaccagcgcaggtttgtcaactacggcgtcaagttcggcgtcggcgacacggtcgtctgcgccgtggacctcgattccnagcccatggcgtcgatagggttcgcgagaaatggcgaatggcttggtattgcgaggcattttgatgcgggcgagaaagggcttggtctggntgacgctcctctgaggcgatgccatggggatccgcactgtttcccatgtcctgctgaagatgttatcgttgagatgcagtcancagggaagatggctgctgcctgttgatggtatgaaccctgggctcagcttttctcaaaggattcagtatttgccctcgttgnacaaattatgggagcctggatgatgcg

SEQ ID NO: 88261 - protein, 134 aa, Zea mays
  misc_feature: Ceres CLONE 1575526
  misc_feature: SWISSPROT Homolog: EC 2.7.10.2 Non-specific protein-tyrosine kinase
  misc_feature (69)..(69): Xaa is any aa, unknown, or other
  misc_feature (99)..(99): Xaa is any aa, unknown, or other
  misc_feature (127)..(127): Xaa is any aa, unknown, or other
MDPTTSGERHLCRIGVSRGDDPVGALGESQHSFGFGGTGKFSHQRRFVNYGVKFGVGDTVVCAVDLDSXPMASIGFARNGEWLGIARHFDAGEKGLGLXDAPLRRCHGDPHCFPCPAEDVIVEMQSXGKMAAAC

SEQ ID NO: 88262 - DNA, 1147 bp, Zea mays
  misc_feature: Ceres CLONE 1575528
  misc_feature (375)..(375): n is a, c, t, g, unknown, or other
  misc_feature (1074)..(1074): n is a, c, t, g, unknown, or other
  misc_feature (1077)..(1077): n is a, c, t, g, unknown, or other
  misc_feature (1122)..(1122): n is a, c, t, g, unknown, or other
ctccccgcggtggcggccgctctagaactagtggatcccccgggctgcaggaattcgtctcacccctagaaaaactcctccgtctccgttctcgtctccgaagacaagaagggaacacgaaccgccggagatgaacaccgccggcgagcctcctttggggcacaagtaagacggcgtactgtagcgcttgtttggtcgtaataggcagggcacgccgcacgcgccattcatgttttggttgccgagtgtgaggacggtggttgtggttggttggagaggggaacgaagggggagggtgtgtgttttttttgttctgttataggtctgcatttgcttgttagtgtgagtgttggttttgtggaattgaagccattntttatcttatcctttgggcccccctgtgtggttatgtttcttaagcctctccactttcctcattcaccgccgctcacaattttaaatggttgtgggcctctagcccaagttctgggatatgacttattgttttcacctttgggagagaataatgcaccgtacttgttaggagattgactcctacccttcagccaaagagtgtgcgttttattgttttggagagacttatcccatatgtcttttgtattaacaggctccgccttctcactttttcttgtggttagttcctgtattgttaccccttcatcaagacatgttgagttgtggcctcctaacactttctgcatcagaggttaagagtaatgactcctacctctcgtttgtctcactgttgtgtacctccttcttgattggccatactctgttctactctgcctgaggtctgcgccacctttttccatcctattttttgttaacgccgcatcaatgctcgtattcgtttatcgtactgctacgcctgcgttggacatgcttatgtttctaatcatttcttggatactgtatcctctttatcatttaacgctctattatgtatcatatctccaacatcattagctgtggttccaattatttagtctatattactctctctaagtaatgtcctctcactacctttcattctacagcggggacaaatgngcntccgctgaggtctcacctaagtatcattactttttagtctacctntcttgttgtcatatctctcttacgg

SEQ ID NO: 88263 - DNA, 868 bp, Zea mays
  misc_feature: Ceres CLONE 1575529
  misc_feature: Encodes the peptide sequence at SEQ ID NO. 88264
  misc_feature (681)..(681): n is a, c, t, g, unknown, or other
  misc_feature (686)..(686): n is a, c, t, g, unknown, or other
  misc_feature (724)..(724): n is a, c, t, g, unknown, or other
  misc_feature (802)..(802): n is a, c, t, g, unknown, or other
  misc_feature (812)..(812): n is a, c, t, g, unknown, or other
ctggagctccccgcggtggcggccgctctagaactagtggatcccccgggctgcaggaattcgtctcacccctagaaaaaagccgattgcttccccgaatctcttcccccaatccggcgcccggcagaatgcgaggccgccacctcctaaaacccatgcccgtcctcctcaacactaccccttcccggccccccgccgcccacttccgcgtccgtgacgcagcccgcccgcccgcgccgctggcagagcccgacgtcggcatctctcgcttcgcctcctccatcccgggcttccgcggcgcgctgaagcagcgctactccgacttcatcgtccacgaggtcgcctgcgacggcgccctcgtccgcctcacttccttcgatctccccgacatcgaggagaacggagataatgcggaggacggtgattccgacgccaccgcggatccatcgcgggcgctcgagtcgttccggctgctctgcggcgaagcggattaccacgccttgaggggattcctggagagggtttcggagggaggtgatggttatttgtcgccaatcattctgtcagctgatgcagataaggcacatcgatccgaggtgcacgagttcatcaagaggaatttcaagttcctgaacacggatacagttgagcacaatgatggtattcagaaatgcattaggntgcgncttgggtcagggccacgctgtggtaggggaaaggacangagaagcatggacacttcatgctggagagatgacaagccgtttgacagtagaggctctacattctgccttatcacctngggaagtccntgaagtttcacctttataggagaacaagaccacatgaggcactagggggtatagaa

SEQ ID NO: 88264 - protein, 228 aa, Zea mays
  misc_feature: Ceres CLONE 1575529
  misc_feature (185)..(185): Xaa is any aa, unknown, or other
  misc_feature (199)..(199): Xaa is any aa, unknown, or other
  misc_feature (225)..(225): Xaa is any aa, unknown, or other
MRGRHLLKPMPVLLNTTPSRPPAAHFRVRDAARPPAPLAEPDVGISRFASSIPGFRGALKQRYSDFIVHEVACDGALVRLTSFDLPDIEENGDNAEDGDSDATADPSRALESFRLLCGEADYHALRGFLERVSEGGDGYLSPIILSADADKAHRSEVHEFIKRNFKFLNTDTVEHNDGIQKCIRXRLGSGPRCGRGKDXRSMDTSCWRDDKPFDSRGSTFCLITXGSP

SEQ ID NO: 88265 - DNA, 945 bp, Zea mays
  misc_feature: Ceres CLONE 1575531
  misc_feature (391)..(391): n is a, c, t, g, unknown, or other
  misc_feature (766)..(766): n is a, c, t, g, unknown, or other
  misc_feature (852)..(852): n is a, c, t, g, unknown, or other
  misc_feature (915)..(915): n is a, c, t, g, unknown, or other
  misc_feature (928)..(928): n is a, c, t, g, unknown, or other
ctggagctccccgcggtggcggccgctctagaactagtggatcccccgggctgcaggaattcgtctcacccctagaaaaacccctagaaaaagcttggttgaggattgagttagttcattatcttctcactcctcatttttttggtttgggtaataaaatgagttaatccatcaccacattattccttatatttagttatttagtactaatatatggaatgtagtcattccactaaatttgaggaatgagcacatgattcatcaattcattttggatcgaatgattcgtcaaacaaacacatcatacaaggattttgcccattttccgccgccaaagcatcgtcttcagttatagtactaatgataaagctgactcggcaaagtacgattnagtattggccggtggtgctgtgaaaaaaagtaggggatgcgtgtttgatttggtcgtgttcagatgcgtcggacggaccccacgcatatgtgtgatgtggtggtagatagagcagctgtgaatgcgtctgacgatcagcgcgaggccggtgagcctgagccccccaccgacagagcagcagaaccaacagactgcaacatctggtgctgcgctgccatgcaacgtgcaccctgccagtgtcagctcaaaagactgcaacatctgttgctcccaccggcccaccaccagacccatcacgatacatacaactgacacgaaatgcaatgcaaatggtgcaggtcttctcccgacggcaacttcgaagatggcccgccnagtcggcgctgtgaacggcacggtggtgtcgggcgccacgccatcccgcggtgggagacgtccggcttcgtggagtactcgagtcngggccaagcaggggaacttgctgcttgtggtgcgcagggcgcgcacccgtgcgctgggcaacnagcgtaatcgggnagcgcctggcgtggccg

SEQ ID NO: 88266 - DNA, 945 bp, Zea mays
  misc_feature: Ceres CLONE 1575532
  misc_feature: Translation starting site: 194
  misc_feature: SWISSPROT Homolog: EC 3.2.1.23 Beta-galactosidase
  misc_feature (828)..(828): n is a, c, t, g, unknown, or other
ctggagctccccgcggtggcggccgctctagaactagtggatcccccgggctgcaggaattcgtctcacccctagaaaaatctctcccactccctcgtccctccccctcgtccagttcactcccattgggcgagaagccgagaaggacagggagggagcgagagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccggggctgctgcagaaggccaaggacggcgggctggacgtggtccagacgtacgtgttctggaacgggcacgagccggtgcgtgggcagtactacttcggcgaccgctacgacctcgtccgcttcgtcaagctcgccaagcaggccggcctctacgtccacctccgcatcgggccatacgtctgcgccgagtggaacttcggcggtttccccgtgtggctcaagtacgtccccggcatcagcttccgcaccgacaacggccccttcaaggcggcgatgcagggcgttcgtggagaagatcgtgtccatgatgaagtcggaagggctgttcgagtggcagggcgggcccatcatcctggcgcaggtggtagacgagtacgggcccatggagtccgtcatgggcgccggcgccaagccctacgccactggggcaggcctagatggccgtcgcacccggncgccggcgtgcccctgggtcatgtgcaaagcagacgacgcccccggacccccgtgatcacacctggcacggcttctactgggactacttcagccccaactcaaaaggcaagccgacc

SEQ ID NO: 88267 - DNA, 866 bp, Zea mays
  misc_feature: Ceres CLONE 1575535
  misc_feature: Encodes the peptide sequence at SEQ ID NO. 88268
  misc_feature (739)..(739): n is a, c, t, g, unknown, or other
  misc_feature (837)..(837): n is a, c, t, g, unknown, or other
  misc_feature (839)..(839): n is a, c, t, g, unknown, or other
ctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggactcttcttcctcttccgccncgcgcatgtcgggccctgcgccaggcctggtgggctcggcgggcccatgtacttctgcgctcaagagcaagttccagaagtgcctgagacggttgcancnttctcgacgttgctgcgctgacaggca

SEQ ID NO: 88268 - protein, 237 aa, Zea mays
  misc_feature: Ceres CLONE 1575535
  misc_feature (103)..(229): Pfam Name: FtsH_ext Pfam Description: FtsH Extracellular
  misc_feature (198)..(198): Xaa is any aa, unknown, or other
  misc_feature (231)..(231): Xaa is any aa, unknown, or other
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRXAHVGPCARPGGLGGPMYFCAQEQVPEVPETVAXFSTLLR

SEQ ID NO: 88269 - DNA, 1989 bp, Zea mays
  misc_feature: Ceres CLONE 1575546
  misc_feature: Encodes the peptide sequence at SEQ ID NO. 88270
aatcgctcttatcgttgacgacacgagcggctgccaattcctgggctcgccattggttggtggcctcgggatctgagagaggaagatggacgacgaggattactcgtgggtgcggcggacgcgcttctcccactccgtcgtccgctccaattccgggagggagcagttcggcgcattcgtcgagcagttcaaccgtggggccgcgctcaggcagaagggctccgcctcggggttcaagctccatggcctcaacatggagccagggacgaggttgtccacatcgtcccttccgacgacgagctcgttctgcgcccagcccaagcccaagcctaaggacatgtcatcttcagacgccaagccggggcagcacgccaaggcagtcagcgatcgcccgtcgtcgcaagaggcatcggcgaggaaggaggacgatgccaaggcttcaaacggaaagaaaggaattggcaaactcagcgtggccgtacctcgggtacccgcggttcagagcgcggaggttgagagcccgggagcactcgagttctccttccaccctgacgagcagagcctgaagctgcagagagcgtgctcaagccctgccccgttcccgcggaacaaaacgcccggcgatgatgccctcacgcgcagctcgtcgctaagtgtgctcggcgaggcgcccaagacgaagcagagggcgaggtctcccctcccgtctcgccacgttgctgaagtgtttcaagaggccaaatcagccaccaagaggttctccactccgccgccgccccggagatccgcgtcttctctagagctgaatggttgtcctccagcgccggtgacggtgagggcaccgggcaagctgaagaataggaaggagggccatgccaacgggaggatgaaggttgctgcaactgcactggaggtactcgagaaatggtccgtcgatcgctcccagctgctcattgggcacagattcgcgtccggggctcacagccggttgttccacggaatctacaaagagcagcctgttgctgtcaagttcatcagacagcctgatgatgaggaagatgcagagctggctgctcagcttgagaagcagttccacaccgaggtcgccactctgtcacgcctcaatcatcctaatgtcatcaagctggttggagcatgcagcagtccaccagtattctgtgtcatcactgaattcctttctggtggttctctgcgagcgtttttgcacaagttggatcacaaagctcttcctctaggcaagatcatctcaattagcttggacatcgcacgcggcatgtcatacattcactcgcagggagttgttcatcgtgatgtgaagccagagaacatcatattcgatgatgtattctgtgcaaagattgttgattttggaatagcttgtgaagaagagtactgtgaccctctggcaaacgacactgggacatttagatggatggctccagagatgatgaagcacaaagcgtacggtcgaaaagtcgacgtctacagctttggccttattttgtgggaaatgttttctggaacgataccatatgaagagctgaacccatttcaagcagctttcgctgtttttgacaagaatgtgaggccggccattcctactagctgcccaacaccagtacgtcttctaattgagcaatgttgggcctcgcatccggagaagaggcctgacttctctcaaatagttcagatactggagaagtttaagagtgttcttgacagagatggcacactcgacaatatgccaagctcgatctgtcaggagactcatgatcacaagaactggcttgctcattgggtccaaaggctcaagcatagccagcctgatctctctgggcctcctccgccaaaactgttgtaactattcaccattcagtaccttctcccttccaaaccctgctaatccgataggcaacagaatgcaatttcaggttattttctgtttatagacaaaaaaaaaaaaaaaaa

SEQ ID NO: 88270 - protein, 598 aa, Zea mays
  misc_feature: Ceres CLONE 1575546
  misc_feature (288)..(544): Pfam Name: Pkinase_Tyr Pfam Description: Protein tyrosine kinase
  misc_feature: SWISSPROT Homolog: EC 2.7.11.1 Non-specific serine/threonine protein kinase
MDDEDYSWVRRTRFSHSVVRSNSGREQFGAFVEQFNRGAALRQKGSASGFKLHGLNMEPGTRLSTSSLPTTSSFCAQPKPKPKDMSSSDAKPGQHAKAVSDRPSSQEASARKEDDAKASNGKKGIGKLSVAVPRVPAVQSAEVESPGALEFSFHPDEQSLKLQRACSSPAPFPRNKTPGDDALTRSSSLSVLGEAPKTKQRARSPLPSRHVAEVFQEAKSATKRFSTPPPPRRSASSLELNGCPPAPVTVRAPGKLKNRKEGHANGRMKVAATALEVLEKWSVDRSQLLIGHRFASGAHSRLFHGIYKEQPVAVKFIRQPDDEEDAELAAQLEKQFHTEVATLSRLNHPNVIKLVGACSSPPVFCVITEFLSGGSLRAFLHKLDHKALPLGKIISISLDIARGMSYIHSQGVVHRDVKPENIIFDDVFCAKIVDFGIACEEEYCDPLANDTGTFRWMAPEMMKHKAYGRKVDVYSFGLILWEMFSGTIPYEELNPFQAAFAVFDKNVRPAIPTSCPTPVRLLIEQCWASHPEKRPDFSQIVQILEKFKSVLDRDGTLDNMPSSICQETHDHKNWLAHWVQRLKHSQPDLSGPPPPKLL

SEQ ID NO: 88271 - DNA, 944 bp, Zea mays
  misc_feature: Ceres CLONE 1575553
  misc_feature: Encodes the peptide sequence at SEQ ID NO. 88272
  misc_feature (848)..(848): n is a, c, t, g, unknown, or other
  misc_feature (891)..(891): n is a, c, t, g, unknown, or other
  misc_feature (935)..(935): n is a, c, t, g, unknown, or other
aaagctggagctccccgcggtggcggccgctctagaactagtggatcccccgggctgcaggaattcgtctcacccctagaaaaaaagcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatgttgagaagcacgtcgctgaggctgacatcatcttcgtctcggtgaacacccccaccaagacccgtgggcttggagctggcaaggctgccgacctcacctactgggagagcgctgctcgtatgatcgccgatgtctccaagtctgacaagatcgttgtcgagaagtccaccgtccctgtcaagaccgctgaggctattgagaagatcttgacccacaacagcaagggcatcaactaccagatcctttccaacccggagttccttgcagagggcactgctattgaggacctgttcaagcctgacaaagtgctcatcggtggccggggagaccccgagggcagtaaagcggtcaggnctctcaagatgtgtatgctcaccgggttccccgagacatgatncttcccaccaacctgtggtcccgctgagctttccaagctcgccngccatgcgt

SEQ ID NO: 88272 - protein, 202 aa, Zea mays
  misc_feature: Ceres CLONE 1575553
  misc_feature (2)..(196): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (190)..(190): Xaa is any aa, unknown, or other
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDKVLIGGRGDPEGSKAVRXLKMCMLTGFPET

SEQ ID NO: 88273 - DNA, 1020 bp, Zea mays
  misc_feature: Ceres CLONE 1575555
  misc_feature: Encodes the peptide sequence at SEQ ID NO. 88274
  misc_feature (571)..(571): n is a, c, t, g, unknown, or other
ctggagctccccgcggtggcggccgctctagaactagtggatcccccgggctgcaggaattcgtctcacccctagaaaaagcacacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgacgaccctctcctggatgatttcaaggccatcttcgagaagttcaccttcaaggacgctgctgcagcggcgggccgaggatgataagaaagacgagggtgccgctgatgccacaaagaaggggtcactgggatgatgatgacgacgaccaagatgatgagccgggaggcaacnatgaggaaggacgggaggcctttcccataagaaagaaaaaactgggaaccccagatgaaaaattgcaaaccctcaaaccgaattgcaaacaaaccctgaccctcctggagaggcctggaaatgcaaccggccggcaaatcccaaatttgggctgggtttttcccaggggggtcccggaaaataaaagtacccggtccccctgggcactggggtccaaaaaagcccaatttccttgcggggggaaaaaaagggttttgaaaaaacccctttttccggttccggagatttttgggggggaccggggaaaaaaaaaaaaaacacggggcttttttggaaaaagaggtacccaaatttttaaaaaaaacccggggggggtttgccccacaggggggaaaagggttaattttaagagggttggggagaccgctcttaaaataaaaaaacccacg

SEQ ID NO: 88274 - protein, 114 aa, Zea mays
  misc_feature: Ceres CLONE 1575555
MAAAAEVDPSPNPPPTTASGLSKTKTREADRRRRRRSKAKKNKSVTEADAQDADGGASSSDAKENADPNPEPQVEVEIEYVPEKAELDDPLLDDFKAIFEKFTFKDAAAAAGRG

SEQ ID NO: 88275 - DNA, 953 bp, Zea mays
  misc_feature: Ceres CLONE 1575556
  misc_feature (871)..(871): n is a, c, t, g, unknown, or other
  misc_feature (888)..(888): n is a, c, t, g, unknown, or other
ggagctccccgcggtggcggccgctctagaactagtggatcccccgggctgcaggaattcgtctcacccctagaaaaaccgtgagcggcctccccactgctctcggcctctacaccttctgctactgcggccatgccatcttcccaacgctctgcatctccatgaaggaaaagaaaaggttctccagggtgagtcgctgtgcattattcatcgaagagtaagacaaccaacgattcctcttttttagttcattctactactgcattttttgtgttgttaaaagtgaaaaataagaggtagacaacatatgcgagttcagctgacaaaagttctatacataccaaaagagagaactgaaaatatctacggcgtatttgttatgctcggtgccttgattagaccctatctcaagaccctacttgacacaggtcagctccactgttaaagcccacgaacagcttttttttaagataagctgttttaaaaaaatattatttgatggaacagttttactaacagcttcatgcatatagttatgagagaaaactaagcgaaagatatgtgaaaagctatttttcagcttcatctccctttgtttatttgtgagagcatgaaaaagaaacttcacctgtaaagctattctagaaaaaagatgtttgacaaaagacaacagtacacaatagtttactaagatactacctccctccgtgttctttttatttgtcgctggatagtgtaaaattgtactatctagcgacaaataaaaagaaaccgagagagtagttacgtagattttgcttacatagatatttatttaaacacttcttgattgtttcatcattagtacatatacatatgttacatatctctnctttgtatgaccaaacnaacatgagttgctgtgatggaaaccacacactttattatactaacgagtaggattggatccgccc

SEQ ID NO: 88276 - DNA, 966 bp, Zea mays
  misc_feature: Ceres CLONE 1575560
  misc_feature: Encodes the peptide sequence at SEQ ID NO. 88277
  misc_feature (447)..(447): n is a, c, t, g, unknown, or other
  misc_feature (452)..(452): n is a, c, t, g, unknown, or other
  misc_feature (453)..(453): n is a, c, t, g, unknown, or other
  misc_feature (470)..(470): n is a, c, t, g, unknown, or other
ctccccgcggtggcggccgctctagaactagtggatcccccgggctgcaggaattcgtctcacccctagaaaaaacgatgatgcactcccagtcgcaggctcccactcccaccttgcggtgctgccgcactctagctgagctgccagctcggatctccatggcctctcttttcctcctcctcctcgtcgtcgtggcggcgctcctctggccgcctgccgtcgcggcgcccgaggagcacctcgtcaccggtctcccgggcttccatggcgccttcccctccaagcactactccgggtacgtgaccgtggacgagcgcagcgagcggagcctcttctactacctggtgctgtcggagcgcgacccggccggcgaccccgtcgtggtctggctcaacggaggtccgggatgctccagtttcgacggcttcgtctacgggaacggacccntcaannttcgagctgggagctcngctgggagcctgcccaagctgcagctcaacccctacagctggtcaaaggtctcgaacatcatgtacctagactcttcctgccggggtgggaatgtcctactccctgaaccgatccggattttgtaacaggggacctgaaaaacggcactgaagcccaaaaattccgtcaaaatgggtccagtttaacccccattttcatttgaacccgtttccattcccggggggatcctataccaggggtttccctcccccaaatcctggaaaaattttttaaaggtttttaaaagggggggaacccccaaaattatttttggggggttttgtaggggaacccgtttaaggggggggaacaaattttattccccctccgccctttggcgggggggagggccccctcccccccccctttgtgaggaggaaaaaaaggccggcgcggcattatttttttccgccccttaaattattctccccaaaaaaaaaacacaaagggcggggg

SEQ ID NO: 88277 - protein, 145 aa, Zea mays
  misc_feature: Ceres CLONE 1575560
  misc_feature: SWISSPROT Homolog: EC 3.4.16.5 Carboxypeptidase C
  misc_feature (97)..(97): Xaa is any aa, unknown, or other
  misc_feature (98)..(98): Xaa is any aa, unknown, or other
  misc_feature (99)..(99): Xaa is any aa, unknown, or other
MASLFLLLLVVVAALLWPPAVAAPEEHLVTGLPGFHGAFPSKHYSGYVTVDERSERSLFYYLVLSERDPAGDPVVVWLNGGPGCSSFDGFVYGNGPXXXRAGSSAGSLPKLQLNPYSWSKVSNIMYLDSSCRGGNVLLPEPIRIL

SEQ ID NO: 88278 - DNA, 947 bp, Zea mays
  misc_feature: Ceres CLONE 1575562
  misc_feature: Encodes the peptide sequence at SEQ ID NO. 88279
  misc_feature (791)..(791): n is a, c, t, g, unknown, or other
  misc_feature (947)..(947): n is a, c, t, g, unknown, or other
ctccccgcggtggcggccgctctagaactagtggatcccccgggctgcaggaattcgtctcacccctagaaaaagaggcggaggaggaggcagctttgtcgcggggcagcagcctacatgaggtcgcgccgctctagctctggttgggctctgcgccgcggggatcggcgtcggctggaggaggaccaggaggggtggcggcgcgaccggctggggcgaacgcggcgtcggtgagaagagaggtctgtgttgtagctgccaagaaatgagcttggggacctgcccggccgcggccggcgactcgacggcagaggagctgcttcaacgggcgcgggggctggtgccacccgcccttgccgctgcgcgcgcggccactggcttcggtgggcggtggaacgctatcccagcgaggctggagaaggtgccaccgtgcctgtcggacctgtccagccacccctgcttttccaagaactcgctgtgtctggagctgctgcagtcggtggctgcgactctagcagaggccgccgagctcggtgcgcgctgccacgagcctccgaaggcagggaagctgcagatgccgagcgacctctacgctctggccgggaagctggacctcaacctcagggactgctccctttcttgtaagactggcgtgctgtctgacgcgaccggttccggcgccccggctgcgtgcgccaagcctgacttgcggggagctgcttgccaggcttcttattggggacccagaggcaaacccccgggctgtggaaggcctgctcgatgctcctgcncgaagaccataaaagcttattgtcgggcgctcggccggtggcacctgggccccccctggtgcacctgctccaggggacgggccccaatggtcagggagaaagccgccactgttttgtggctttgcttgccaattctggggacctgcaagggcccan

SEQ ID NO: 88279 - protein, 227 aa, Zea mays
  misc_feature: Ceres CLONE 1575562
  misc_feature (176)..(176): Xaa is any aa, unknown, or other
MSLGTCPAAAGDSTAEELLQRARGLVPPALAAARAATGFGGRWNAIPARLEKVPPCLSDLSSHPCFSKNSLCLELLQSVAATLAEAAELGARCHEPPKAGKLQMPSDLYALAGKLDLNLRDCSLSCKTGVLSDATGSGAPAACAKPDLRGAACQASYWGPRGKPPGCGRPARCSCXKTIKAYCRALGRWHLGPPWCTCSRGRAPMVREKAATVLWLCLPILGTCKGP

SEQ ID NO: 88280 - DNA, 950 bp, Zea mays
  misc_feature: Ceres CLONE 1575563
  misc_feature: Encodes the peptide sequence at SEQ ID NO. 88281
  misc_feature (805)..(805): n is a, c, t, g, unknown, or other
  misc_feature (883)..(883): n is a, c, t, g, unknown, or other
tggagctcaccgcggtggcggccgctctagaactagtggatcccccgggctgcaggaattcgtctcacccctagaaaaagggcgatggagtagcgcatcgcatccacgacgcggcaacagcaacaccgcaccatggcgcttcttcttcatccccgcctcccgtcccatcctttccgcgcggcagcccaccaccaccacgccatctcgaacgcctcttgattcattaccctacacggccccggaaggaagagccacatgctgctcgcggcggtcacgtgccgcgcagccagggtcaaggagcccgatccgagcgcaagcgcctcgcctccgacgccgccacaagagctgacgaaggacgcgcacaagtacttcgaccacgacgtggacaccgtccgcgcgggcaacagcaggcacggtgccgtgctcgccatgccgccggcgccctccgcggacgccgacaagccacgcggcaggttcaaccggggcgagaagaagagcaagaaggtgtcgtacaagcgcaactacgacaggtccgtggcagcatgcctacaggcgggcacggcggcaacgttgtggtgtacacccacgaggccgaggagacgctgctgcggttccacgagaaggcgcggtactgcgccaaacggggagagaacaatgagcgccgctggcgacacgctcagctcgcggatgcacagcgagttcgccagagagacgctcatgataccagtgcctgtaggaactgttgtgaaacgcaagaaaggcgctgatctggcggatttggctcatcacagtgatgaagtgctgnctgctagaagtggacatgacggaatcatcttgatagatgtgcctgaatacagaacgacgaagacatggcttaaccccnacagcatgcgagaactagtgacaaagatgacgcatcgtcaacctggtgagaactaagctgtattgaa

SEQ ID NO: 88281 - protein, 227 aa, Zea mays
  misc_feature: Ceres CLONE 1575563
  misc_feature (184)..(184): Xaa is any aa, unknown, or other
  misc_feature (210)..(210): Xaa is any aa, unknown, or other
MLLAAVTCRAARVKEPDPSASASPPTPPQELTKDAHKYFDHDVDTVRAGNSRHGAVLAMPPAPSADADKPRGRFNRGEKKSKKVSYKRNYDRSVAACLQAGTAATLWCTPTRPRRRCCGSTRRRGTAPNGERTMSAAGDTLSSRMHSEFARETLMIPVPVGTVVKRKKGADLADLAHHSDEVLXARSGHDGIILIDVPEYRTTKTWLNPXSMRELVTKMTHRQPGEN

SEQ ID NO: 88282 - DNA, 898 bp, Zea mays
  misc_feature: Ceres CLONE 1575564
  misc_feature: Encodes the peptide sequence at SEQ ID NO. 88283
  misc_feature (831)..(831): n is a, c, t, g, unknown, or other
  misc_feature (870)..(870): n is a, c, t, g, unknown, or other
ctccccgcggtggcggccgctctagaactagtggatcccccgggctgcaggaattcgtctcacccctagaaaaaggctctgccgcactcgtcttctctcttcctcttctctctgtctctcctaccctccgtcaccacttcgtccctatggcaagggagcttctcccggcctcttcctaccagactatcctcctgccgcaacggacctgacggtttccctccatctggcctccctgtcgcgcgagctgatcgacccacgcaagcgcaatgccgtccagaggctagttcgagctgctgagcgctgatcacggtgaggccacccagatccacccgactgccacccggatttcgcaccttgccttttcttctctcgttcacccagctggctcgctcgctcctccctctctagtgggcaactgccaactgggcgactcgccgacgcccctacgccaggtgctcaggtcttcgtcgggtcttttgccggcgacgaacacacaccagggtattgtgtagagctatcatctccctcggtttcttggaagaacaattatttgacataattatcaccataagatgcctggaattacagaggatggacttgttgcagaggaggtgccgagcggtgtgaatttctctccacagaacgaaagtctgcctgccccaaagtcgacagcagcttcatcgatggcgggtagcatgcaaagcgaggcgcttgagatgcatggttgagcctccggtgctgggggaccctcaatcgagcaactctacaacaacgtatgcgagatggagagctcaagtgagggtgctccccatcacgcgagagcttggctcngacgggaagagtctagattgactcgaagctcgactcttngttgctgggagatggagcatgaagtgat

SEQ ID NO: 88283 - protein, 51 aa, Zea mays
  misc_feature: Ceres CLONE 1575564
MPGITEDGLVAEEVPSGVNFSPQNESLPAPKSTAASSMAGSMQSEALEMHG

SEQ ID NO: 88284 - DNA, 931 bp, Zea mays
  misc_feature: Ceres CLONE 1575566
ctggagctccccgcggtggcggccgctctagaactagtggatcccccgggctgcaggaattcgtctcacccctagaaaaacctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgacctacctgctgctggaggagcccatccggatgggcctccatcctggagccatcccaagacaaggcttcttcccgggcgatgaaccaagaatcgtcggggacgccccggccccccaaggtcgcggctcccggtcaaaaacccattttccctccctggccttaaggggcccgggaatgtttcctctccccccccggggttcaaattttccccccggggggagaaacccccccccctctccccccggggaaaaccccccggaaaaaccccaaggcgccccccctttaaagccccccccaaaaaaaacttgtgggcccctttttttttctttaaaacccgtggttggaacccccacaactcccgggggggggtacaacaaaaaagaggaaaaacccccctttttccccttaaaaaaaaaaaagaggtttttttttttgtccctcccccccctttgggggggaaaaaaaaacccccctcccccccgtggtggggcccccaaaatttttatgggaaccccccccgcgggttttttcccccccggggggaaaatttttttgtgggggggaaaaatttttttcttttgtgggggagaaagaacccctcttttgggggggggg

SEQ ID NO: 88285 - DNA, 1036 bp, Zea mays
  misc_feature: Ceres CLONE 1575567
  misc_feature (911)..(911): n is a, c, t, g, unknown, or other
  misc_feature (1020)..(1020): n is a, c, t, g, unknown, or other
  misc_feature (1036)..(1036): n is a, c, t, g, unknown, or other
ccccgcggtggcggccgctctataatagtggatcccccgggctgcaggaattcctcttcccctggaaaaactgctttcttagaggtgggtcggcttctcctccccctcctgttctcgttctgttccctgaggttctccggcgcctcctctactccggcctgccctacacgcgggcgcccgggttctacaacaagctctcttaccacttcagcccgctccccgcccgatacaccattcattccaacacgccttgggcggatagcagtgatgccctccagtccgcatcttcactcgaccaggaatccgactcgtcccccggttttcgcttctgcaccttttcccggaaggaaagccactccaaaaccgttggacgagggcttcaaagcttacgactgcaccgaccgctttggtgtcccctaaaagtgctccaagccccttggctcgttcaaggcagggcagctctcatcgggtacggtgatggcccctccgaagcatgcggcctatcccctgtgccggcccccctcgttataagccccctttttcacccattggagcaggccgaaacctttctcatggaggctgaccttcttctgccgggtgggaggcttgggccctcaccgtttttagtaatacccctttgccgtttttccaacagtattacttcgccaatcggcacctggattgtgaccttgagcgtgtgggtgggccccgccccggcccaaggtcaatccctaggttccttttaccagatagctttgtcccctaatgcgcattatgtgcctttattttgttgggggcccccaaacatgtggtttgtttcggccccttttatggtgtctattccctgcttcgaaaaccccgcatgaattccgctcaacaattctcgcgagccgcgtccccgcgtcgtttcnttctcgaatccctcgtagcgctcctttgactggcgacatcctgacttgaaccctcggccgctatttcctcgctttaaaccgctgtctctcccgcttcttctgcgcgttntgtcttcctacacggn

SEQ ID NO: 88286 - DNA, 920 bp, Zea mays
  misc_feature: Ceres CLONE 1575570
  misc_feature (920)..(920): n is a, c, t, g, unknown, or other
tacccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaagccgcggccgacgacggggagctcgccgctcggtggagggaggtccacggcagcaacaacttggggagggtctgctggaccccatccacggcgtgctcctccaggagctcatccgctaaggggagttcgcccaggcctacttctacagcttccactaggaccgcttctccccctactggcggagcttcaagttcccggggaaaataccttccttccaagacctgggccctcggagggatcggctacgaggtcaaccgcttacctcctacgccacctggaaaaaaccttaaagttcccacacctcggaaataaaaatggcggccaatgcccaagatgtgggaagggagcccggggacgtttaaagagggtaacggaggcccgtttcccccccaaaaagagaaagggtccggtctcggacacccagatgaatacttccctgtgggttggggaggtcacaatgtaaccggccn

SEQ ID NO: 88287 - DNA, 889 bp, Zea mays
  misc_feature: Ceres CLONE 1575571
  misc_feature: Encodes the peptide sequence at SEQ ID NO. 88288
  misc_feature (747)..(747): n is a, c, t, g, unknown, or other
ggagctccccgcggtggcggccgctctagaactagtggatcccccgggctgcaggaattcgtctcacccctagaaaaagctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatccttaagcacaagaatcctaagactggaaagtatgttgagcatcatctcaaattcccaccatctgtcccatatgacaagctctctcatgtctacacggctatcttgaagccagacatgaggtcaaatttttggtagatggggaagaaaagagaaggcgacttccttnctgctgatgatttgagccagcacttatccctccatgacattcctgacctgatgacaaaaaccgaagactggatgaaaaacttaatcctgatccaatgcttaaccctgatactgggatgagatgccccatggaaattggataa

SEQ ID NO: 88288 - protein, 191 aa, Zea mays
  misc_feature: Ceres CLONE 1575571
  misc_feature (24)..(192): Pfam Name: Calreticulin Pfam Description: Calreticulin family
MGGRALLLLLLVSALVFQIHASDPLLYEPFDEDFEGRWVVSKKDEYQGVWRHAKSDGHEDYGLLVSEKARKYAIIKELDEPVTLKDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDMRSNFW

SEQ ID NO: 88289 - DNA, 1029 bp, Zea mays
  misc_feature: Ceres CLONE 1575572
  misc_feature: Encodes the peptide sequence at SEQ ID NO. 88290
  misc_feature (431)..(431): n is a, c, t, g, unknown, or other
  misc_feature (970)..(970): n is a, c, t, g, unknown, or other
ctcaccgcggtggcggccgctctagaactagtggatcccccgggctgcaggaattcgtctcacccctagaaaaacccgtgctcgtcatcaccacccacatctcagttcaccccggcgtcgtcctcttcccccggagctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaaagcaatgtcagaagctgggatcaagtacattcccagcaacaccttctcgtactatgaccaggtcctttgataccacgggcatgcttgggtgctggtccagagcgctactcttggactggaggcnaaaattggcttgaccacttatttctcaatggccaggggaaatgccccctgtcccggcttatgaaattgaaccaaagggggttggatccaaaacaacccctttttttggccccgaaacttgggcccaagaccccaagttccaataccctttcccaagggggttttttttgagaaaaaggggggaaaacccccccccgattttttatctgcccccagggttttgtgggaacaggggtaaaaattggccccctccaaaaccccgccaagggggggggaaaaaattttttccccctttttttcgccttggggggaaatttttcccacctaaaaaaaggaggttttttttaaaaaaggagaggcgggggggccctcggggaaacccttttagaacacccaccctcctttaaaaaacactttgtttccaaaaaggggggccctctcctcccccaaaagaagaaaaaaaaggcgcgccccccgggaggaagggggtgaaaaaaaaattttttgtatttttctgggggaacaaaacaaccccccccnagggggggggggggccgccctttttttttttttttgttggaacaccctctttttttttg

SEQ ID NO: 88290 - protein, 69 aa, Zea mays
  misc_feature: Ceres CLONE 1575572
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSADDLEKVASDLRSSIWKAMSEAGIKYIPSNTFSYYDQVL

SEQ ID NO: 88291 - DNA, 949 bp, Zea mays
  misc_feature: Ceres CLONE 1575573
  misc_feature: Encodes the peptide sequence at SEQ ID NO. 88292
ctggagctccccgcggtggcggccgctctagaactagtggatcccccgggctgcaggaattcgtctcacccctagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaacaagtactttggatgtgagcttggtgcaccagtccaatttgatgagaagacagggatttcttggtttaaggggctcatgatactgcaaagcggggtggcctccttgaggtttcatccagaagttgtccaaatgtttggggtgggaaaacccggaaaaaaaaatcctttcccaagacccaatgattccctaaatgtgcccccgtgggttcccccccaattttgttatgggagaaatccccaaccttcttttgtgaaaccccccaaaaaaaagagggggaaaaaaaaaagcccttgagagattaaaaaaacct

SEQ ID NO: 88292 - protein, 81 aa, Zea mays
  misc_feature: Ceres CLONE 1575573
  misc_feature (1)..(81): Pfam Name: eIF-5_eIF-2B Pfam Description: Domain found in IF2B/IF5
MALQNIGASNRDDAFYRYKMPRMITKIEGRGNGIKTNVVNMVDIAKALARPASYTTSTLDVSLVHQSNLMRRQGFLGLRGS

SEQ ID NO: 88293 - DNA, 971 bp, Zea mays
  misc_feature: Ceres CLONE 1575574
  misc_feature: SWISSPROT Homolog: EC 2.6.1.44 Alanine--glyoxylate transaminase
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (701)..(701): n is a, c, t, g, unknown, or other
  misc_feature (741)..(741): n is a, c, t, g, unknown, or other
  misc_feature (832)..(832): n is a, c, t, g, unknown, or other
tccccgcggtggcggccgctctagaactagtggatcccccgggctgcaggaattcgtctcacccctagaaaaagtttgagaagctcagagatctcggggtactagttggaaagggcggtctgcatggtaacgtcttcagaataaaaccaccgatgtgcttttcgaaggacgatgcagacttcttggtggactccatggactacgcaatgtcaaggctctgaaggaacatgctctgagttgacaatgtgtctgcgtggaaacaacacttcctgcaaccgcaagatgcatggcctgaaatgaaactgaaaggcagatgatttaatgggcatgctccccgggtggtatgttggtgtttattggtgaaagtttaatagtccccctcccccgaataaattgatgaaaggggacagaacgtcttgcccagcttgtgaactgtttgtagaagaactgcagttaataaatagaatagcgagcaaannnnnnnnnnnnnnnnnnnnnnnnnnnnnnnnnnnnnnnnnnnnnnnnnnnnnnnnnaaaaatccccttcaaccccacgtctctctccgccgaaggctccggccttcgtcgggatcccggtgctgagattgacccaatggggcccgctccaagccggggttggcgccggccctccttcgcggccgttaatcaacaaggggggaacccccggctgttcttcctgncccgttcgccgtaacacccccggaaggagggggggcctcntggccggttcgccgtcgcctgccgctccctcgtcaaagaaaagcgtttcttgtcgtgcccgcttgctgggcccactgaaacaagggcgggnccgcccgggggcaatcccttctttgtggtggttggtaaccccgggggctcatggggtccggtgaaggacctgttatgactcatctgcttgggccccccttggtgaaaggaatcgcttccccctgggaaaaatcccgagg

SEQ ID NO: 88294 - DNA, 841 bp, Zea mays
  misc_feature: Ceres CLONE 1575576
  misc_feature: Encodes the peptide sequence at SEQ ID NO. 88295
  misc_feature (792)..(792): n is a, c, t, g, unknown, or other
  misc_feature (793)..(793): n is a, c, t, g, unknown, or other
  misc_feature (799)..(799): n is a, c, t, g, unknown, or other
ctggagctccccgcggtggcggccgctctagaactagtggatcccccgtggctgcaggaattcgtctcacccctagaaaaagttctgcaccgcaccctctcactcatcgacccccgccgtagtagatggctagatgccaaaatcccaaatcccttgtgaacctcctaaacctaagcgatggcggtggcggcatcgccgtatttcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatgccccccgtcaactacaccgtctcgggcgtccccatccgcctgctcgcgctctccgtctccgatcccgacgtcccgctcggccccggcgtcgacgagtcctacacgctctccgtgccacccaattccagctccgctgacatctctgccgccactccctggggcatcatccgcggtctcgagaccttctcccagctcgcctggagcagcggcgccgccgacgcgagcggccagtcgatcgtccccagcgagatagaaatctcgtacaccccctattcaccccacgcgggatcctcctcgacaccgcacggaactactaccccgtcggttgaatcnntcgcancattcgcggcatggcctcaacaagctcaatgtatccacctgc

SEQ ID NO: 88295 - protein, 221 aa, Zea mays
  misc_feature: Ceres CLONE 1575576
  misc_feature (55)..(184): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature (206)..(206): Xaa is any aa, unknown, or other
  misc_feature (208)..(208): Xaa is any aa, unknown, or other
MAVAASPYFLLLFLFHSLAALASLAPPPSQPPPPRVPQKVQVWPKPVSISWPLPAYAPISPSFNIRASPSHPSLRHAIAYYTRLIRTERYTPIMPPVNYTVSGVPIRLLALSVSDPDVPLGPGVDESYTLSVPPNSSSADISAATPWGIIRGLETFSQLAWSSGAADASGQSIVPSEIEISYTPYSPHAGSSSTPHGTTTPSVESXAXFAAWPQQAQCIHL

SEQ ID NO: 88296 - DNA, 951 bp, Zea mays
  misc_feature: Ceres CLONE 1575577
  misc_feature: Encodes the peptide sequence at SEQ ID NO. 88297
  misc_feature (775)..(775): n is a, c, t, g, unknown, or other
  misc_feature (834)..(834): n is a, c, t, g, unknown, or other
  misc_feature (846)..(846): n is a, c, t, g, unknown, or other
  misc_feature (938)..(938): n is a, c, t, g, unknown, or other
ctccccgcggtggcggccgctctagaactagtggatcccccgggctgcaggaattcgtctcacccctagaaaaattacccccaggccccagcgtgcgtggtctccttcctctcgtggcgacgaccgagcggccgtcgctgcttacgtgcccagtcctgttcgtcccttcgccggcgacggccacgacctggttataggcaaagtttgtcctgaactgttcatcatggtggaaggctgggtattctctgctttgttagtggtgtttctagcgttcacaacaccttgcgagtcattctacttgccaggtagttatatgcacacatatcagcaaggtgaagtaataagggcgaaggtgaactctctcacttccattgagacagaactacccttcagttactacagccttccatactgtcgtcccagagatggggttaagaagagtgctgaaaacttaggcgagcttctgatgggtgatcaaatagataattctccgtaccgtttccgtgtaaatgtcaacgaatctctgtatctgtgtactacaaccccacttgacgaggctaatgtgaagctcctcaagcagcgtagccatgatctataccaggtgaacatgattcttgacaatcttcctgtgaggaggttcacagagcagaatggaataaccatccagtggacaggctatccagttggttatattccagaaggcacttctgatgtctacatcatcaatcacctgaaatttaaggtcttggtccataagtatgaagggagcgaagtnaaggtagttgggactggggaaaggaaatggagtgatctcagagactgacaaagatgccnattctggatatngagattggtgggaattgaaaagtgtcccatgtcagcgtgttgcgtgatcctgaatcccatatgaaagctaatatgtatgattaagtcgatcntgtgaactgccct

SEQ ID NO: 88297 - protein, 199 aa, Zea mays
  misc_feature: Ceres CLONE 1575577
MVEGWVFSALLVVFLAFTTPCESFYLPGSYMHTYQQGEVIRAKVNSLTSIETELPFSYYSLPYCRPRDGVKKSAENLGELLMGDQIDNSPYRFRVNVNESLYLCTTTPLDEANVKLLKQRSHDLYQVNMILDNLPVRRFTEQNGITIQWTGYPVGYIPEGTSDVYIINHLKFKVLVHKYEGSEVKVVGTGERKWSDLRD

SEQ ID NO: 88298 - DNA, 953 bp, Zea mays
  misc_feature: Ceres CLONE 1575578
ctggagctccccgcggtggcggccgctctagaactagtggatcccccgggctgcaggaattcgtctcacccctagaaaaagaaatgcgaaaggcagccgaggccgcgagccgacgcacgcggctcgttgcttcctccatcccctttcctcacgccgacgccaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacgatgagcctgtcaccgctcgactcctcctccccgccgtgccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggtgccggggcggtcccggcaacaggaccaaccgcgctacgccgagggggtactggaagacacgggcaaggaccgcgaggtgcacaccgcggcaagcccgtccggatgaagaaacgctcgtctccacgccggggaggcgcctaaggcgagaggaccactgggtcatgcacgagtaccgcctcccgatgcgacggactcaggacttgcatgtggttgtagaatctccaaagcatggtctggacacataacgggcgcatatgtgcacataagt

SEQ ID NO: 88299 - DNA, 960 bp, Zea mays
  misc_feature: Ceres CLONE 1575580
  misc_feature: Translation starting site: 168
  misc_feature: SWISSPROT Homolog: EC 3.5.1.14 Aminoacylase
  misc_feature (298)..(298): n is a, c, t, g, unknown, or other
  misc_feature (795)..(795): n is a, c, t, g, unknown, or other
  misc_feature (798)..(798): n is a, c, t, g, unknown, or other
  misc_feature (801)..(801): n is a, c, t, g, unknown, or other
  misc_feature (817)..(817): n is a, c, t, g, unknown, or other
  misc_feature (950)..(950): n is a, c, t, g, unknown, or other
  misc_feature (951)..(951): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (958)..(958): n is a, c, t, g, unknown, or other
  misc_feature (960)..(960): n is a, c, t, g, unknown, or other
ctggagctccccgcggtggcggccgctctagaactagtggatcccccgggctgcaggaattcgtctcacccctagaaaaatttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgagaancgcggcggcggggggaagggcgccgcgaccgcgaacgcgagcgggaggcaccagcaccggcgccagcgctacggcgtgggggcgccgtggagggaggagaaccggggctggggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgctaccggcgtcgtcgccacgctcggcaccggccgcccgcccgtcgtcgcgctccgggccgacatggacgcgctgcccatccaggaaggccgtgggagtgggagcacaagagccgggtccccgggaagatgcacgcgtgcggccacgacgcgcatgtggccatgctgctcagcgccgcagcatcctcaaagctcgcgagcacaactcaagggcacggtgaaacttctgttcagnccngcngaagagtcgggctgcngcccctaacgaatgatccagaccgcgcccctggaaggcgtgaagcccatcttcgcgtggacgtgtcgcacagcacccgaacttcgtgggcgggtccaagaaggggccctctcgcggctcgctctagggaaaannannnngngn

SEQ ID NO: 88300 - DNA, 911 bp, Zea mays
  misc_feature: Ceres CLONE 1575581
  misc_feature: Encodes the peptide sequence at SEQ ID NO. 88301
  misc_feature (721)..(721): n is a, c, t, g, unknown, or other
  misc_feature (765)..(765): n is a, c, t, g, unknown, or other
  misc_feature (821)..(821): n is a, c, t, g, unknown, or other
  misc_feature (826)..(826): n is a, c, t, g, unknown, or other
  misc_feature (894)..(894): n is a, c, t, g, unknown, or other
aagctggagctccccgcggtggcggccgctctagaactagtggatcccccgggctgcaggaattcgtctcacccctagaaaaagtccgcccgcgcgccatcctccccgcgccatgcccatgcgcacgcgcacgcgctccaccccttgagcacgcacgcacgtcgccgccgccacacgcatccgtctccgcctcccgtacgtgtccatggccgccgccacggcggccgggcggctgctcctggccgcggcggcgctcatcctcgcggcggcgtccagcggcgtcaccctggcggcggctcaggccaagtcggaggccgatgtcctgagcgagttccgggcgacgctgcgggggccggacccggacggcggcccgccggcggagctgaaccagtgggcgacggggggcgcgccctgcgacggcaacgcgaccagctggcctcgagtgaggaggtgcgtcgatggccgagtggtggtcctgcagctggagggcctccggctgcagggcgccgcgccggacctggccctgctcgcgccgctccggagcctgcgctcgctcagcctgagcaacaacagcctcgcgggcgcgttcccggacgtgtcgccgctccccgcgctcaggttcctcttcctctggcagaaaggctcgccggggagatccccgacggcgcgttcgcggccctcagggggctccagaaggtcgacctctccgggaacgagttcntcggcccgataccaggctcatcgcgtcctccgccaggctgctgntcgtcaacctcgcaacaacacttctcgggcccgtcccggaaggggctccggagtangcgcnatgtcagctcaagggacaaattctctgcggggaatggtcggcacccgtgccctccgcccctcctcggncctctcgctcgtatccg

SEQ ID NO: 88301 - protein, 235 aa, Zea mays
  misc_feature: Ceres CLONE 1575581
  misc_feature (187)..(187): Xaa is any aa, unknown, or other
  misc_feature (206)..(206): Xaa is any aa, unknown, or other
  misc_feature (230)..(230): Xaa is any aa, unknown, or other
MAAATAAGRLLLAAAALILAAASSGVTLAAAQAKSEADVLSEFRATLRGPDPDGGPPAELNQWATGGAPCDGNATSWPRVRRCVDGRVVVLQLEGLRLQGAAPDLALLAPLRSLRSLSLSNNSLAGAFPDVSPLPALRFLFLWQKGSPGRSPTARSRPSGGSRRSTSPGTSSSARYQAHRVLRQAAXRQPRNNTSRARPGRGSGVXAMSAQGTNSLRGMVGTRALRPSSXLSLVS

SEQ ID NO: 88302 - DNA, 858 bp, Zea mays
  misc_feature: Ceres CLONE 1575582
  misc_feature: Encodes the peptide sequence at SEQ ID NO. 88303
  misc_feature (471)..(471): n is a, c, t, g, unknown, or other
  misc_feature (519)..(519): n is a, c, t, g, unknown, or other
  misc_feature (520)..(520): n is a, c, t, g, unknown, or other
  misc_feature (560)..(560): n is a, c, t, g, unknown, or other
ctggagctccccgcggtggcggccgctctagaactagtggatcccccgggctgcaggaattcgtctcacccctagaaaaagtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgcctgcggtgggcgtctacgtgatcaacttcgtcatgtccatgtccacgcagatcttctgcgggcagctcggcaacctggagctncgcgccgcgtcgctcgggcacaccggcatccagtccctcgcctacggnnctcatgctgggatggccagcgccgttggataccctgtgcngggcaggcgtaccgcgcgcacaagcacggcatggctggggggtggtacctgcaacgggtcgaccgtggctgctgatgggcaccgccttgcctctggaccggtgtggtagccctctcggggccgaataccggtgggtccccgggcgaatccgaaccccattccaagggccccccccctggttctgtaccgctctattcccgcaaaattttgggtaccgggggaattccccctcccaaaattccgggggggcaaaaaaattgggggcccaagccatcaattcccggggcacccgtggggt

SEQ ID NO: 88303 - protein, 161 aa, Zea mays
  misc_feature: Ceres CLONE 1575582
  misc_feature (113)..(113): Xaa is any aa, unknown, or other
  misc_feature (126)..(126): Xaa is any aa, unknown, or other
MDSTTTTTAPLLQPAAAASSKEEPAPASPHGAGSWELEAVLADASSPVLRRAWEGARLELPLLLRVALPAVGVYVINFVMSMSTQIFCGQLGNLELRAASLGHTGIQSLAYGXHAGMASAVGYPVXGRRTARTSTAWLGGGTCNGSTVAADGHRLASGPVW

SEQ ID NO: 88304 - DNA, 2398 bp, Zea mays
  misc_feature: Ceres CLONE 1575585
  misc_feature: Encodes the peptide sequence at SEQ ID NO. 88305
tttacgccagcgagtgaagaactacttcctccctcccttctgccttctcccctgccccctctctcatcactctcagatctctccctccccctccctccttcccttcatctctctgaattctgcacacctcgccgtccacgcattccgcgctcgccctcgcggatccggcagccctttcttcgccgtcgttcttgcctccgctgtcctgctctcctggaggctgctgttgggtcaccagtggctggactcgaccccgcggcctccggggggtgggttcgctggatggttatcgcctcctgatccatccggaccccggatcctctgcaaaggcaccgcctttgtgggttgggttctctgcgcccatgcagaagggtttggcgcgtcggcggtgaggcagggctctggtttagttcttgcgttggactagtccggagatgcttcgtggaacggggtacgggggcggcgatgcgcggaggcgggcactgcgctcgtcgcggcggcatctgccggggtggatctggtggcttctcgggatcttcctcctcgtcgggctcatgctcttcgtcctgcaccacaaccaaaaggagcagttccggccgcccgtcgtggataatggttcagcgatccaggaagtccctcgtgaaaaagtgaatttctcagaagaacttttgagcagcacatcatttgctcgccaattagtggatcagatgactctagcaaaggcatatgtcatccttgcaaaagagcaaggtaatcttcagcttgcatgggagcttagttcacagataaggaattgtcaaagattgctatctgaaggggcagttaatggaagagcaatcactaaagatgaagcccatcctataataagccggctagcacggttaatatacaaggctcaggactctcactatgatatcagcacaacaatagtgacattgaagaaccatgccttggcactagaggagcgtgcaaaggcagcaattgttcagagtgctgagtttggccagttagcagcagaatccttccccaaaaatctgcactgtctaactgtgaaactgacagaggagtggcttcggaacccgaagcataggagtcactcagaggagaaccggaattccacacgattggtggataataatctgtaccatttctgtatattctctgataatgtgctggccacttcagttgttgtcaattctacggtctccaatgcaaatcatcctcaacagcttgtgtttcatgtggtcaccgacagaatccattttggcgcaatgtcaacttggttcctcataaatgacttcaaaggttgtactgttgaagtccgctgcatagatgagttctcgtggttgaatgcttcttcatctcctcttgtcaggcagctatctgaggcggaaactcagggttactattactcagctggttccaagaatcctgaaagagaaacaaaattccataatccaaagtttgtttctctactgaaccatttacgtttctacattcctcagatacttcccaacttggagaaggtggtgtttcttgatgatgatgttgtggtgcaaaaggacctgactcagctgttctccattgagttgcatggcaatgtcattggagcagtggaaacctgtttggagtcgtttcatcgatacagcaagtatctaaatttttcgcaccctaccatcagctccaagattgatccacatacttgtggatgggcttttggaatgaacatttttgacttgatagcctggaggaaggcgaacgccacatcgttgtaccattattggcaagagcaaaattcagatctattgctctggagaacgggaattcttcctgcaggccttttgacattttacggcctggtggagcccctagaccgcagatggcatgtcttgggtcttgggtatgatgtagacatagatgaccgtttgattgagagtgctgctgttgtgcactataacggaaacatgaaaccgtggctgaagctggctattcgccgttacaagtatatatgggagcggtatgtgaatatctcacatccgtatgttagagagtgtatgttgcaatagaaagcctgcaaatctctgtatgttcttggatggtgttgaagctgtttcctcacacgaggctgctttcgagcacattgtatgagggaaaggttcagaggtagtagaatatataccagtcatcaaagaagtcaactgttaagtttctttttctttttgggttgggggaagattcattttgagatgaaaataattcctttgcagagtttacatacaaatctggactgggaattttagcagtctaaccagatacatctggatagatattgtaaaagagatacagttggatcaatgagcattttttctttgagatttaggaaaaaaaaaaaaaaaaa

SEQ ID NO: 88305 - protein, 543 aa, Zea mays
  misc_feature: Ceres CLONE 1575585
  misc_feature (203)..(518): Pfam Name: Glyco_transf_8 Pfam Description: Glycosyl transferase family 8
  misc_feature: SWISSPROT Homolog: EC 2.4.1.58 Lipopolysaccharide glucosyltransferase I
MLRGTGYGGGDARRRALRSSRRHLPGWIWWLLGIFLLVGLMLFVLHHNQKEQFRPPVVDNGSAIQEVPREKVNFSEELLSSTSFARQLVDQMTLAKAYVILAKEQGNLQLAWELSSQIRNCQRLLSEGAVNGRAITKDEAHPIISRLARLIYKAQDSHYDISTTIVTLKNHALALEERAKAAIVQSAEFGQLAAESFPKNLHCLTVKLTEEWLRNPKHRSHSEENRNSTRLVDNNLYHFCIFSDNVLATSVVVNSTVSNANHPQQLVFHVVTDRIHFGAMSTWFLINDFKGCTVEVRCIDEFSWLNASSSPLVRQLSEAETQGYYYSAGSKNPERETKFHNPKFVSLLNHLRFYIPQILPNLEKVVFLDDDVVVQKDLTQLFSIELHGNVIGAVETCLESFHRYSKYLNFSHPTISSKIDPHTCGWAFGMNIFDLIAWRKANATSLYHYWQEQNSDLLLWRTGILPAGLLTFYGLVEPLDRRWHVLGLGYDVDIDDRLIESAAVVHYNGNMKPWLKLAIRRYKYIWERYVNISHPYVRECMLQ

SEQ ID NO: 88306 - DNA, 1330 bp, Zea mays
  misc_feature: Ceres CLONE 1575591
  misc_feature (337)..(337): n is a, c, t, g, unknown, or other
  misc_feature (808)..(808): n is a, c, t, g, unknown, or other
  misc_feature (972)..(972): n is a, c, t, g, unknown, or other
  misc_feature (998)..(998): n is a, c, t, g, unknown, or other
  misc_feature (1162)..(1162): n is a, c, t, g, unknown, or other
  misc_feature (1223)..(1223): n is a, c, t, g, unknown, or other
  misc_feature (1330)..(1330): n is a, c, t, g, unknown, or other
ctgttttgcactcattgccactcgtttcaatacaatcatttctcagtttgggtagggggtggggtgtgtagtgtggggtactcacgcgggggcggccgctctataactagtgagatcccccgggctgcaggaattcgtctcacccctagaaaaaactacacctctccctccctccgcctccatctccttcgcctccagaacccaagcgctgccccacacgccgccgcagcccgcacgggtaccgcgcgccgcaccaaaaccctaggtctcctccgtcccccgatccatcgccttcatggtcgcgccggcatcgtggcggccggggtcttgtaggaantgacttctgcccaaattggggggcaatgcgtgccgggagtagtactaccttgtggttggaccgtccgccggaaccgggggtacggatttcctccggggggtgggcccccacaaccgaccacaattcccccctctaaccccccggggttgcacaccacccccacccttgaaggggatgtggggcgagaatagaaggaccccccccccccctcataaggggggtggtgatcgccccccacgctactcaataggaatagtatggggcgcgtccgtgagaatgtgtgttactttacaaagagtcggaattaggcaatgttgccataaacgcgtactgtccggttacacgagatgagttggatggatagtctgcgcacgcacaggggtgcgcacgccactctaactaagggggcgatgttatagggcgtgatgcgatgcgtggggagcaaggtggcttatatttgatggcacacangagtaataataacaccggtatatgtgcgcgcgtgttcgtttatgctgatacggaagggcgcacatggttgtgagagagagagagtgtgtcgtctacggagacgagggcgccggcagcgtatcgagggtgctccgccgtgaagtgagactccggtgtgctgttanacgttccgcgtctgtggatgagagcncagcgtgtcatagttaccacaccactatctttcttcatgcgtgcagggagatgatgatcggcccctctgggaacaacacactgtatatggatggagagccacagcgaccactgcgcgacagagtccctgtagacgtagacttgatctggcaggcactgcaacantaagatgagcatatcgtcatgtggccggcccgctacatgcgtagatcgagactcgcgtgcngctaattcgcgatacctacccaccgtatatggtttcagggtagagctgaggatggcgcttccatctcgaccagcataagcgccgttgtattctcctctgcacgtgan

SEQ ID NO: 88307 - DNA, 936 bp, Zea mays
  misc_feature: Ceres CLONE 1575595
  misc_feature: Encodes the peptide sequence at SEQ ID NO. 88308
  misc_feature (722)..(722): n is a, c, t, g, unknown, or other
ggagctccccgcggtggcggccgctctagaactagtggatcccccgggctgcaggaattcgtctcacccctagaaaaattttttgagaactccccttctccgccactaccgaagcccttgtacccctcaccgccgccgctgctgctagggagcttccacccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccgccggcgccggcggttgtgctgccgcctccgccgcaggtgatccgcatgttcgccgcgcctcccccgccgccgcgtgggggcttcttctccgcgccgcagccccggccgttcgagtactatgcgcctatcggtgaacgcagcggatttgctgccatagagcaacaggcgccggagctggtagcggagatgctcccgcccgccgcggtgaagacggagccagtggtggatgggctcgacgacgaagtggtgcacaagatcaccaagcaggtggaatactattttagtgacatcaaccttgctactacagaacatctgatgagantcataccaagggatctgagggtatgtgccaatatcagtaattgctgggcttaagaaagtaaaaactctgtgcgcaatatgtgatgcttgctgcggctctccgaactcatcaaaacttggttgtagcgatgacggtaagagagtcaaaggcagcagcatttacagatctgatttgcagaccccagtccccgattgttgagcgaaaatactcctgt

SEQ ID NO: 88308 - protein, 175 aa, Zea mays
  misc_feature: Ceres CLONE 1575595
  misc_feature (32)..(49): Pfam Name: PAM2 Pfam Description: Ataxin-2 C-terminal region
  misc_feature (159)..(159): Xaa is any aa, unknown, or other
MPQMEGSTDQIAAGWFAKEPASERPVGLPRTGSSSRLNAQAPEFVPRGPPPPAPAVVLPPPPQVIRMFAAPPPPPRGGFFSAPQPRPFEYYAPIGERSGFAAIEQQAPELVAEMLPPAAVKTEPVVDGLDDEVVHKITKQVEYYFSDINLATTEHLMRXIPRDLRVCANISNCWA

SEQ ID NO: 88309 - DNA, 950 bp, Zea mays
  misc_feature: Ceres CLONE 1575597
  misc_feature: Translation starting site: 338
  misc_feature: SWISSPROT Homolog: EC 4.1.1.50 Adenosylmethionine decarboxylase
  misc_feature (238)..(238): n is a, c, t, g, unknown, or other
  misc_feature (661)..(661): n is a, c, t, g, unknown, or other
ctggagctccccgcggtggcggccgctctagaactagtggatcccccgggctgcaggaattcgtctcacccctagaaaaatcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtngaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccnatggctgttctttctgctgctgatgcttccccggtctcagctatcgggtttgagggctatgagaagcgccttgagatcacatctctgaggcacctgtctttgtggacctcatggggttgtggttgcgtgccctctccagggcccagattgactctgttctggatctgcaccggtgcacatcgtgtccgagctcctcaccaggatttcgactctatgtcctttccggagtcagcttggttttctatcctctgaaaatggcctcaagacctggggcactacaagctcttgt

SEQ ID NO: 88310 - DNA, 961 bp, Zea mays
  misc_feature: Ceres CLONE 1575598
  misc_feature: Encodes the peptide sequence at SEQ ID NO. 88311
  misc_feature (917)..(917): n is a, c, t, g, unknown, or other
ctggagctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgacaacctgatcgggacgctgacggtgcgcgagacgatcggctactcggcgctgctgcggctgccggaacagatgccgcgggaagacaagcgcgcgctggtggaaggcaccatcgtcaagatggggctgcaggactgccccacaccgtcatcggaactggcacctcccggggtcagcggcggcaaaagcggcccgtcagattcgggttgaactatcatgcggcngcgcctcttctcctgaaggagccacaaggggctcaaaagcttgt

SEQ ID NO: 88311 - protein, 227 aa, Zea mays
  misc_feature: Ceres CLONE 1575598
  misc_feature: SWISSPROT Homolog: EC 3.6.3.28 Phosphonate-transporting ATPase
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNGRKAKLSFGAAAYVTQDDNLIGTLTVRETIGYSALLRLPEQMPREDKRALVEGTIVKMGLQDCPTPSSELAPPGVSGGKSGPSDSG

SEQ ID NO: 88312 - DNA, 974 bp, Zea mays
  misc_feature: Ceres CLONE 1575599
  misc_feature: Encodes the peptide sequence at SEQ ID NO. 88313
  misc_feature (1)..(1): n is a, c, t, g, unknown, or other
natagctggagctccccgcggtggcggccgctctagaactagtggatcccccgggctgcaggaattcgtctcacccctagaaaaagccattttctcacccttcaccttgattcatccatcattcacgccagtacgccacgcctccgcgttccacgttccttctcggctctacgtcaccgtaacctcctccacccatccggccatcccccttctcacgcggctcgctcagggctcgagcgtctccccatcggaaccctaatcctctctttccctactcgcggaagccaactccaccggcaggggaagcggaagggaagcacctcggccccggcaagatggtgctcgcacagctgggcgggagcatctcccgcgccctggcgcagatgaccaacgccacggtgatcgatgagaaagtgctcaacgagtgcctcaacgagatctcgcgcgcgctcctacaggccgattgtcaattcaagatggtccgcgacatgcaagctaacatcaagcgcatcgtcaacctcgaggcgcttgccgcaagcaccaaccaacgccgcatcctggcaaccagctgtcttcaccgaactttgcaccatggtagaatcccggggaagcccttctttcactcccaaaaaaggccaagcccaaccgtaagtcctggttcctttgggcctgcaaagggtctgggtaaaaacaaccaacttggtacaaaaaaagtgcttattatcctttcgaaagaaaagaatcaaaacccgccccggggtttggggctgaaaacttttaagggccggggcgcttttcatccgttaaaagaaaaatggaaggaaaggcgcaaaattccccttttttgggaaacctacatggaaactcgaaccccttaaaaatttcttttttagagggggggagaaggttccaaaaaagaaacacggggattccctctttgggggaacaaaagggaaaggccaatacagaagcgg

SEQ ID NO: 88313 - protein, 180 aa, Zea mays
  misc_feature: Ceres CLONE 1575599
  misc_feature (2)..(85): Pfam Name: SRP54_N Pfam Description: SRP54-type protein, helical bundle domain
MVLAQLGGSISRALAQMTNATVIDEKVLNECLNEISRALLQADCQFKMVRDMQANIKRIVNLEALAASTNQRRILATSCLHRTLHHGRIPGKPFFHSQKRPSPTVSPGSFGPAKGLGKNNQLGTKKVLIILSKEKNQNPPRGLGLKTFKGRGAFHPLKEKWKERRKIPLFWETYMETRTP

SEQ ID NO: 88314 - DNA, 1040 bp, Zea mays
  misc_feature: Ceres CLONE 1575600
  misc_feature (229)..(229): n is a, c, t, g, unknown, or other
  misc_feature (376)..(376): n is a, c, t, g, unknown, or other
  misc_feature (634)..(634): n is a, c, t, g, unknown, or other
  misc_feature (781)..(781): n is a, c, t, g, unknown, or other
gtccccgcggtggcggccgctctagaactagtggatcccccgggctgcaggaattcgtctcacccctagaaaaaaggagaagttggttagccatagggctatttataagccgcatggcagcagggaataaatcaagcaagatcaattatccaaagctgctcttctcccttgcctctctcaagccaccggtgaggaatccctcacggtgaaggtctggagcgcgactacnaactgcgtagccgcggtccagcgacgttgggcgtcgaggcgcttgacaagtggtcagggaagacaaaaggctgctgaccgtccttttccagatggccgtgatggtcgcgccttttcccccacagcagaaggggggggggagtgttcnattggaaaacatcactggaagaagctcttgcccaagctccaaatgcaggttctgtcggaggggggataaatggaaatttttccccatggaccacaactggaaggggttttgaaagagggctattccccccaattggggaaaagaaagaaaaaacccttccccaaaaacccccctttggttggtttgtgggcaggggcctcataatccatagtttgtgtcccctgggggtagaaaaaactaatgaattgcgtggcgagnctccccccttccctttttcttcctctgggaagaaaaaaagaaggtctgttggggcggcttccccccccgcctttatggaaaaacatgtggggcctactaacacaagtgtgggggaaaaagagagaaatatttcgtgccgccgctcangtagttgtgcgcaatatatagtgtggggatgaagaggagtgtttttcccccgcgggcgggatatctccgtcccccgttgatatccgtcgccctcataccccgggtgggggagcgggtggtctcttgtctctgcgctccatacacgtatgtctctgtcctccttccttatgtggtgtactgggcacatactttttgtgaaaaacgcacggggcttgctttgcgtgtctggggtcactcttctatactatctcccccatgg

SEQ ID NO: 88315 - DNA, 928 bp, Zea mays
  misc_feature: Ceres CLONE 1575608
  misc_feature (554)..(554): n is a, c, t, g, unknown, or other
  misc_feature (846)..(846): n is a, c, t, g, unknown, or other
ctccccgcggtggcggccgctctagaactagtggatcccccgggctgcaggaattcgtctcacccctagaaaaaaattccatatgttaactgctactctcttgtccctgagtattatggtgtccgagaacctgctgttgtaaattctctctccattgaactgtcatctctcccctgttgcaccttcttgctagatagctacggttaccattcatctactttgaatgcctaccgtacatcctctgtgtgatttctcactgatgcctcattggatcgagcacccaccacgcttttccctgcatggacacccgtctccctgctatacaaaacatgttcaaggatcctatgcgcctacctgtccagagaatagcgcttcttgttcctcaccatgcgacacatgatgatattgacgctgcctctatcagctgcgatcctgcacctatttcaaatgcatccacactcgattgcttgccagtaccgacttatatcggatgatcaactgccactacatgataataatgcaaggctctttgcctgttgctatgaccttaatgntagagctcaacaatgctgggaattcacagactagtttcctgccattaatactactgacctacttactactacctgtagtgtacagccctagtagaatgcattgagacgtgctatatgtggtaatcagcaggcacttcattttgcaagtgatctcacgagacacaagagttacttctgaggctgctttcatcaagatcaacagcagttcccagcgaatgattcatatgtgccagctgctgaaaactttttacatggcatggacatgcacaactttagctgcgatttgataaantaatcatggtttgagaagctccaactaagaattggaaccatctaatagccaattattcacccgcttgaaagaaccgaatcct

SEQ ID NO: 88316 - DNA, 980 bp, Zea mays
  misc_feature: Ceres CLONE 1575609
  misc_feature: Encodes the peptide sequence at SEQ ID NO. 88317
  misc_feature (773)..(773): n is a, c, t, g, unknown, or other
ctggagctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgcgcccctggtccttttgcgctttctcgtccctctttctctccatctctccttattcttctccttccacggagaagccggcgggctggtatggatcccaatggcctcaaaactggagggcttttgctcccgaccatcgagaggcgggggcacgtcgcctccatccggcatttgtcatcggcggtgggattttcgggcgttgcagctgcccgtgcccctctccaatttcttcttttaaaggggactggttttggaaatccaagagaatcgttttgggcgggggcctttcattactggatacccccgtttgggttgccccaattggattgggggagcccccatggcttccccgggggggtgggaagggaaaatccacggngacccttggtataacctttcctggggctggaggttttcccgcccaaggcgatgataaaccccgtttcggtatgtaacctggatttagaaagcctttccccctttttaaaagataggaattcaggcccccagggaaatggccaataattggggaaacctccaaaaaattctttataaaacggaaaattgccttaaccagaaccccccg

SEQ ID NO: 88317 - protein, 100 aa, Zea mays
  misc_feature: Ceres CLONE 1575609
  misc_feature (97)..(97): Xaa is any aa, unknown, or other
MDPNGLKTGGLLLPTIERRGHVASIRHLSSAVGFSGVAAARAPLQFLLLKGTGFGNPRESFWAGAFHYWIPPFGLPQLDWGSPHGFPGGVGRENPRXPLV

SEQ ID NO: 88318 - DNA, 948 bp, Zea mays
  misc_feature: Ceres CLONE 1575612
  misc_feature: Encodes the peptide sequence at SEQ ID NO. 88319
  misc_feature (729)..(729): n is a, c, t, g, unknown, or other
  misc_feature (732)..(732): n is a, c, t, g, unknown, or other
  misc_feature (752)..(752): n is a, c, t, g, unknown, or other
  misc_feature (757)..(757): n is a, c, t, g, unknown, or other
gcggtggcggccgctctagaactagtggatcccccgggctgcaggaattcgtctcacccctagaaaaaatcattttggcagcacgcccacacagcagcatcaacctcgggtgctctgcggccactggactgccctgccagtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgaccctgcggctggtgctgcaggccgtcatgctgatcggctgctgcctgttcttggctgcgccctcgtctacgcgccgcggcaatcatcgcatgctcatcgtcgggagatgctgctncgnctggggctcggcttctcggncaggncacggcggtgtacctcgccgagtgtcgccccgcgctggcgcggcggctcatctctggcttcccctctcatcaggttcgggtactgtggctactcatcactacggacctgcggatcccggctgggctgcgcctctgttggcctgctcgtccgggcccctcatgttggtcgggcccgtcatccgtaccccagg

SEQ ID NO: 88319 - protein, 216 aa, Zea mays
  misc_feature: Ceres CLONE 1575612
  misc_feature (144)..(144): Xaa is any aa, unknown, or other
  misc_feature (145)..(145): Xaa is any aa, unknown, or other
  misc_feature (152)..(152): Xaa is any aa, unknown, or other
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTLRLVLQAVMLIGCCLFLAAPSSTRRGNHRMLIVGRCCXXWGSASRXGHGGVPRRVSPRAGAAAHLWLPLSSGSGTVATHHYGPADPGWAAPLLACSSGPLMLVGPVIRTP

SEQ ID NO: 88320 - DNA, 953 bp, Zea mays
  misc_feature: Ceres CLONE 1575615
  misc_feature: Translation starting site: 213
  misc_feature: SWISSPROT Homolog: EC 3.4.23.12 Nepenthesin
  misc_feature (881)..(881): n is a, c, t, g, unknown, or other
ctggagctccccgcggtggcggccgctctagaactagtggatcccccgggctgcaggaattcgtctcacccctagaaaaagtcttccccgacccgcgtttctttattatattttcccccaaattccacctccaccaacctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccgggcgtcttcgtctccgcggcgggcgctgtcggagcggatgattgcgacggtggagtccggcgtggcggtcgggtcccgccagtacctgatcgacgtctacgtcggcacgccaccgcgggttttcccgatgatcatggacacccggcagcgacctcaactggctgcagtgcgcgccgtgcctggactgcctcgagcagcgtggcccggtgttcgaccccccggcgtcctcctcctaccgaaacgttactggggggacaagggctgcggccttctgggcgccccccaggcgccgaaggcgtgccgccncccgccggagaactctgtccgtactactactggtacggggaccattccaaactacccggaaacttgccctgg

SEQ ID NO: 88321 - DNA, 1002 bp, Zea mays
  misc_feature: Ceres CLONE 1575618
  misc_feature: Encodes the peptide sequence at SEQ ID NO. 88322
atagctggagctccccgcggtggcggccgctctagaactagtggatcccccgggctgcaggaattcgtctcacccctagaaaaaaagaaagtgccttgcttccctttccccctcgtctacgttcatggtgcttgtggccgtcaaccggcaactccggcgcgggggcctctaatggcgcagtacatgcatcactacggcgtcagcttttccgactcccgctgccaccatcaccaggtgctccctgactggcacctgccccaccacgccttccgccaagtcctcctcacggatcctccgccccgggaagcctgcgccgcgccgccgctcgccggctagctgctgcagccgtcgccgccgctctactcctcgcctccgtattcctcctttcgcgccgcatctcgcgcagccccgaagagatcatccaagattcgagcgctagggagacgttgcctgactggaaccagagcaagagctggaaagagctcatgttcgggctccgcggacgtggcctctacgcgctgatactccatgtactgggaccaggacgataggctccgcgactaggactactcagaggacgaaaagcagaagatctcggatggaagtgggacctccggagatgctggcggcagctgctataaaggtaccacctctggggaaagtcgggaaggaataaaggtgtgactaccgggagcgatgctagagacgtcacccacccgtaggaagattgggaaacggggcccttagtaaattgaggggggcaggaaccatccgggaagcctacaagggaggagcctctgtgaggcacctcaacgggggtgttaagacgtttgagccccataagtaggtgcagcaaagactcttcccgccctgtttaatggaagaatttgaacccgcctaaaattaagggccaaaggatacttggtagacccccaaacaaggtgggggaaaataacattttctccttgaaacgacaaggaaacttccgtttgaatctaacct

SEQ ID NO: 88322 - protein, 54 aa, Zea mays
  misc_feature: Ceres CLONE 1575618
MAQYMHHYGVSFSDSRCHHHQVLPDWHLPHHAFRQVLLTDPPPREACAAPPLAG

SEQ ID NO: 88323 - DNA, 1016 bp, Zea mays
  misc_feature: Ceres CLONE 1575619
  misc_feature: Encodes the peptide sequence at SEQ ID NO. 88324
  misc_feature (1016)..(1016): n is a, c, t, g, unknown, or other
aaagctggagctcaccgcggtggcggccgctctagaactagtggatcccccgggctgcaggaattcgtctcacccctagaaaaatccaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacaaagaggcccgcccccgcgtcaatgccagcagcgagtggatcctcgactgcatcgcccacgggcggcgacatctacggcgtcaccaccggctttcggcgggaacctcccaccgccgcaacaaagtacggtccccggcctccaggttcgagcttgctcagggcttctcaacgccgggaatcttcgggcaccggtaagcgaacgggcaacacgcttggccgtccggaaggcaccccgcggcgggcaatgctgggtggcccatcaaacacccctcctccaaggggttaacccccgggattccgctttccaaaatcctccgaaggcccatccacggaagcttggctcaaaacccgggggtgtaagccccttggcttgcccgttcccggggaaaccaatcacccggggtcggagggaacacgggttccccgtctctccaaaattgggccggggcctatataaggggcgccccccaaacagcgaaagggcggttcacccttctaaaggaaaagagaagtgggaaccccccccaaagagctttataaaataccccgcggactcaagggcgggttcctctctagacccaaaaccccaaggtgaggggcctcccacattttatn

SEQ ID NO: 88324 - protein, 135 aa, Zea mays
  misc_feature: Ceres CLONE 1575619
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASAKDASGVAVELDKEARPRVNASSEWILDCIAHGRRHLRRHHRLSAGTSHRRNKVRSPASRFELAQGFSTPGIFGHR

SEQ ID NO: 88325 - DNA, 972 bp, Zea mays
  misc_feature: Ceres CLONE 1575621
  misc_feature: Encodes the peptide sequence at SEQ ID NO. 88326
  misc_feature (484)..(484): n is a, c, t, g, unknown, or other
aagctggagctcaccgcggtggcggccgctctagaactagtggatcccccgggctgcaggaattcgtctcacccctagaaaaagaaccctctcgcgcttggctttctttcactctccagggctccactcccatctcgccgccgcagccatggcgatcacagcgccaactcccgacatcctcggcgagcgccaatccggccaggacgtccgcacgcagaacgtgatggcttgcggggcggtggccaacatcgtcaaatcctcgctcggccccgtcggtctcgacaagatgctagtggacgatattggtgatgttacaatcacaaatgatggagcaaccatacttaagatgttggaagttgagcatccagccgccaaggttcttgttgagttggctgaactccaagaccgtgaggtaggagatggaactacttccgttgtcatcatagcggcagagttactcaagagaggcaatgatcttgtgaangataagatcccatccacttctataatcagtggctacaggcttgctatgcgtgaagcctgcaaatatgttgaggaaaagtagcagtcaaggttgacaaacttggaaaagatcccttatcaactctgcaaaaactagcatgtcttcgaaattgattaatagtgacagtgatttctttgcaactttgttgttgaggcaggtcaaggcggggaagactacaatgcccaagggagacgtgaaatatccaatcaagagcatcaatattttggaagcccatgggtaaagcggcaagaatagttatctgttggaatggttatggccaaaacacaggcggggcagctcaaggaatgcctaccaaagtaacccccgccaaaaatggccggccttgattttacacctccaaaacaaaaaaggccacttggtggccaaagtctttggaccggatcccagggggacctggaaaagatccgcccaaagagaatcggaaataa

SEQ ID NO: 88326 - protein, 138 aa, Zea mays
  misc_feature: Ceres CLONE 1575621
  misc_feature (112)..(112): Xaa is any aa, unknown, or other
MAITAPTPDILGERQSGQDVRTQNVMACGAVANIVKSSLGPVGLDKMLVDDIGDVTITNDGATILKMLEVEHPAAKVLVELAELQDREVGDGTTSVVIIAAELLKRGNDLVXDKIPSTSIISGYRLAMREACKYVEEK

SEQ ID NO: 88327 - DNA, 938 bp, Zea mays
  misc_feature: Ceres CLONE 1575622
  misc_feature: Translation starting site: 258
ctggagctccccgcggtggcggccgctctagaactagtggatcccccgggctgcaggaattcgtctcacccctagaaaaatctcccccccgcctctgctctcctttctcccgtccccgcacaaaaacatttgcaccccctcccgactgctactgccgctgcctcctctccctttccgcctgccttcgctctcctcgtcgtctcctccgtctagggttctccaccccacccgccccgccgccgcccgatccgaggcagatgccgcccgcagccatggcgctgccgtcccaggccccgtctaactcaggggatccgctgtacccggagctctggcgcgcctgcgccggcccgctcgtcaccgtcccccgcgtcggcgacctcgtcttctacttcccccagggacacatcgagcaggtggaggcgtccatgaaccaggttgccgggaacccgatgcgtctctacgatctgccttccaagctgctctgccgcgtgctcaacgtcgagctgaaggcggagaccgacaccgacgaagtgtacgcgcagatcatgctcatgccggagcccgagcaaaacgatgtggctgccgagaagacgagctctgggtctgctgcgccaccgaggccagcggtcaggtcattctgcaagacgctcaccgcctccgacacagcacacacggcggcttctctgtcctgcgcccgcacgctgacgagtgcctcccctgcctggatatgtcccagtcgcctccactcaggagctggtggcgaagatctgcatggcatggaatggcgattccgcacatcttccgcgggcaaaccagagcatctcctcagaaggggtggatggttttgtcagttccaaaaggctgtgctggagacgcttcttttctcagagaaaaacggtgaactccagttgggttaggccctatgaggagtgtctatt

SEQ ID NO: 88328 - DNA, 890 bp, Zea mays
  misc_feature: Ceres CLONE 1575623
  misc_feature: Encodes the peptide sequence at SEQ ID NO. 88329
  misc_feature (536)..(536): n is a, c, t, g, unknown, or other
  misc_feature (673)..(673): n is a, c, t, g, unknown, or other
  misc_feature (674)..(674): n is a, c, t, g, unknown, or other
  misc_feature (679)..(679): n is a, c, t, g, unknown, or other
  misc_feature (705)..(705): n is a, c, t, g, unknown, or other
  misc_feature (735)..(735): n is a, c, t, g, unknown, or other
  misc_feature (740)..(740): n is a, c, t, g, unknown, or other
  misc_feature (741)..(741): n is a, c, t, g, unknown, or other
  misc_feature (750)..(750): n is a, c, t, g, unknown, or other
  misc_feature (752)..(752): n is a, c, t, g, unknown, or other
  misc_feature (761)..(761): n is a, c, t, g, unknown, or other
  misc_feature (772)..(772): n is a, c, t, g, unknown, or other
  misc_feature (825)..(825): n is a, c, t, g, unknown, or other
  misc_feature (834)..(834): n is a, c, t, g, unknown, or other
ctggagctcaccgcggtggcggccgctctagaactagtggatcccccgggctgcaggaattcgtctcacccctagaaaaaccccggccctgctggcccttctgcctgccactcctccctcctctcttcgttgcccctgccgtattcactttcactcgttcgtccatccttccacgccccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgngcctcgtggcgggcttcctcgtcgtcacctgcgcctacttctcccacgcaagttcgacgccatccagatcgccatgaccagccgacccgtctccagcaatgcggccggcgtcggagtcggctcgctgggagtgggcnngcgcngcgccgacacctcaacgcctccagcnaggattagatttggcgcgatgtcatggccnaagannggagcgagncntagcgctcnaaaagacggcngcaagctttctcacttcggggccaggtcttggtcagggttctgcgctctcttnctccgtgtngtcagagaagcgcgacagccgcaggatcagtgagaagcacactcacctcactgcag

SEQ ID NO: 88329 - protein, 60 aa, Zea mays
  misc_feature: Ceres CLONE 1575623
  misc_feature (36)..(36): Xaa is any aa, unknown, or other
MDAGGGKLPYSYAGQQDGGKLVKSVSRVEPRRFGLXLVAGFLVVTCAYFSHASSTPSRSP

SEQ ID NO: 88330 - DNA, 851 bp, Zea mays
  misc_feature: Ceres CLONE 1575626
  misc_feature: Encodes the peptide sequence at SEQ ID NO. 88331
  misc_feature (851)..(851): n is a, c, t, g, unknown, or other
ctggagctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggaggaggacggcgtcgatgacctggacaacgagttcaactgggacggccatgactcgcagtctgtggccgagtccatgctctacggccacatgagctacggccgtggaggtgaccctaatggcgcgccacaagctttccagctcaaccccaatgttccactcctcaccaacgggcagatggtggatgacatctcaccggagcagcacgcgctggtgccttctttcatgggtggggggggggaaagaggatcatcccctttcttatgcggatcctagcttan

SEQ ID NO: 88331 - protein, 192 aa, Zea mays
  misc_feature: Ceres CLONE 1575626
  misc_feature: SWISSPROT Homolog: EC 2.4.1.12 Cellulose synthase (UDP-forming)
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGDPNGAPQAFQLNPNVPLLTNGQMVDDISPEQHALVPSFMGGGGERGSSPFLCGS

SEQ ID NO: 88332 - DNA, 868 bp, Zea mays
  misc_feature: Ceres CLONE 1575627
  misc_feature: Encodes the peptide sequence at SEQ ID NO. 88333
  misc_feature (405)..(405): n is a, c, t, g, unknown, or other
aaagctggagctccccgcggtggcggccgctctagaactagtggatcccccgggctgcaggaattcgtctcacccctagaaaaaacacactccaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccaccacncaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacctagaacatatatccgacaagtttgagttcagtgcagacaacattgaacccctggtccagacctgcatgacaactctatcctcaaagattgttaaccggttgcaagcgggcgttgggcagagattgctgtcaaagcagtaccttgcggttgcagatctggagaggagggatgttaactttggatcttattaaagtagaaggccacggttggtggggaacttgaaggacacttgaacttgtaattggaaattatggtttgacaaggatatgagccatcctccacc

SEQ ID NO: 88333 - protein, 206 aa, Zea mays
  misc_feature: Ceres CLONE 1575627
  misc_feature (84)..(84): Xaa is any aa, unknown, or other
MALAFDEFGRPFIILREQEKKTRLRGLDAQKANIASAKAVARILRTSLGPKGMDKMLQSPDGDVIITNDGATILEQMDVDNHHXKLMVELSRSQDYEIGDGTTGVVVMAGALLEQAEKLLERGIHPIRVAEGYEMASKVAFDHLEHISDKFEFSADNIEPLVQTCMTTLSSKIVNRLQAGVGQRLLSKQYLAVADLERRDVNFGSY

SEQ ID NO: 88334 - DNA, 853 bp, Zea mays
  misc_feature: Ceres CLONE 1575631
  misc_feature: Encodes the peptide sequence at SEQ ID NO. 88335
  misc_feature (850)..(850): n is a, c, t, g, unknown, or other
ctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgccgcgcgcagggcgggcccggcgccgggcctggtgggcctcggcggcccatggacttcggccgctcccagagcaagttcccagagtgcctgagacgggtgtcaccttnctc

SEQ ID NO: 88335 - protein, 232 aa, Zea mays
  misc_feature: Ceres CLONE 1575631
  misc_feature (103)..(227): Pfam Name: FtsH_ext Pfam Description: FtsH Extracellular
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRRAQGGPGAGPGGPRRPMDFGRSQSKFPECLRRVSP

SEQ ID NO: 88336 - DNA, 683 bp, Zea mays
  misc_feature: Ceres CLONE 1575635
  misc_feature (91)..(91): n is a, c, t, g, unknown, or other
  misc_feature (606)..(606): n is a, c, t, g, unknown, or other
  misc_feature (607)..(607): n is a, c, t, g, unknown, or other
tggagctccccgcggtggcggccgctctagaactagtggatcccccgggctgcaggaattcgtctcacccctagaaaaagttcttctctcntccttcttcctcggtcctctcctctccgcatttcgggcggccacttgtggcggcgtagctagcgtactacagctccctgcatggtgatggaggggcgcacgggctcactctacggccgcctcaacaagagcagcacgcggggggtcctcgcctacaccgccgcccggggctgccctgcgcgctgttcctcgccctggtttcgggggctctccccccccccggggaaattcccggaatttggggggccaaaaaggggaagccctccccttgccccgcctcacccgggggttgggccaaactcccgtttaaaaggggggggggggggggccccccccccccgggggggttcccccgggtcccccttttggaaaccccccccggggggggtttttggggggggaggggggaaatattttttttggcccccaagaaaaaaaaaaaaaaccctttggggggggggggggtgttaaaaaaaaaaaaaaaaaaaaaaaaccccgccccggcgccgggggggnnaccccaaaaaaaaaaaaaaaaaaaaaaaagggggggggcggcgccccccccaaaaaaatattttgtggggggggaa

SEQ ID NO: 88337 - DNA, 740 bp, Zea mays
  misc_feature: Ceres CLONE 1575638
  misc_feature: Encodes the peptide sequence at SEQ ID NO. 88338
ctggagctccccgcggtggcggccgctctagaactagtggatcccccgggctgcaggaattcgtctcacccctagaaaaaacaccacccacctccatagcagcctactatcctctccttcctccattctctcgctatcttccccactccccagccaacaaatcgaccttgctgggaacgagagggctatagagcctggggagggcagcgcaacacgcgccacggagcagcggcggcggcggcggcggcagagcagtccgccgggagcagaggccgcgcgcgcagcgcaggcagccatgggcgcgccggtgaacggcgccgtcgtcttgttcctcctgctgctggctggaacgggggcggtgaccgaggagacggctccgcaggaacccacattgcccgccgccggctccggctccggctccggcgccggcgccggcgcggcggtcggggtcaactccaactccgtgctggtcgcgctgctcgactcgcactacaccgagcttgcggagctgggtgaggaggcgctgctcctgcagacgctggaggacgccgtcgggaagcacaacgtcaccatcttcgcgcccggaaacgaggcgctggagcgggacctggacccgggagttcaggcgcttccctgctgggagccccccaacctcagggtccttgcaggggcctgcttgttttaccaagtcctgcccttcgggctggcccttccgggtttggggcccccgggccccgcca

SEQ ID NO: 88338 - protein, 148 aa, Zea mays
  misc_feature: Ceres CLONE 1575638
MGAPVNGAVVLFLLLLAGTGAVTEETAPQEPTLPAAGSGSGSGAGAGAAVGVNSNSVLVALLDSHYTELAELGEEALLLQTLEDAVGKHNVTIFAPGNEALERDLDPGVQALPCWEPPNLRVLAGACLFYQVLPFGLALPGLGPPGPA

SEQ ID NO: 88339 - DNA, 949 bp, Zea mays
  misc_feature: Ceres CLONE 1575639
  misc_feature: Encodes the peptide sequence at SEQ ID NO. 88340
  misc_feature (177)..(177): n is a, c, t, g, unknown, or other
aagctggagctccccgcggtggcggccgctctagaatagtggatcccccgggctgcaggaattcgtctcacccctagaaaaaaacctcccttggtttggctggcggctagcccctaaccaaaaaaaataaaataaaaccaactctcccattcggccatttgcccatttcccatctcngccttcagcttcccacgaccacctccgtcccgcgctcgccgcggcaaggcaccgccgccaaccgccctcgtccctcttcgactcgaccgcgtgagtgagacgaccgcgcgcgcccctcgcccgcccgccaggaggagatcgacccccgaacgcgtcatgaagtacgtgctggtgaccggcggcgtggtgagcgggctcgggaagggcgtgacggccagcagcgtcccccccgtcctcaagtcctgcgggcctcgcgcgtcacctccatcaagaatcgatccgataccctcaaccatcggaggcccggaaaccatgttctccccgcttcgaagccatgggccgaaattggtttggtttttttggaaccaaacgggccgggggaaaagggtgggaaaattttggaaaaacctttgggggaaaacctacccgaaaacccggattttcttggtgggaaaaaatttaaaagagcttggggaaatttcttcgggggcccacccccaggacatatatacccccccgggggggggaaaagaaaaacttaaccccgcgggtcctcgggtgtttattgtgggcacagagggggaaaattttttggagaggggggggaaattccccccgtaggaaaaaaaaaaaggttgttcctcgggggtggtggggcgccctcgcctctttttccacaggaggtggtaaaaaaccgccccacacgggggggggtttgttaacaaccgtgggtggggaaacaaaagaaaaaacccgccttgttggtgaggac

SEQ ID NO: 88340 - protein, 154 aa, Zea mays
  misc_feature: Ceres CLONE 1575639
MKYVLVTGGVVSGLGKGVTASSVPPVLKSCGPRASPPSRIDPIPSTIGGPETMFSPLRSHGPKLVWFFWNQTGRGKRVGKFWKNLWGKTYPKTRIFLVGKNLKELGEISSGAHPQDIYTPPGGGKEKLNPAGPRVFIVGTEGENFLERGGKFPP

SEQ ID NO: 88341 - DNA, 850 bp, Zea mays
  misc_feature: Ceres CLONE 1575642
  misc_feature: Encodes the peptide sequence at SEQ ID NO. 88342
ctggagctccccgcggtggcggccgctctagaactagtggatcccccgggctgcaggaattcgtctcacccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcggtgcggatgcgcgcgccctctcgcggggtccgcgggggctccgcgctgcgggtcacgtgcgagaaggtggtggggatctacctaggcaccaccaactccgcggtcgccgccatggagggcggcaagccgaccgtcgtcaccaacgccgagggcgcgcgcacaactccctccgtagtggcgtacaccaagacaggggagcgcctggtggggcagatcgctaagcgccaggcggtcgtgaaccccgagaacaccttcttctctgtcaagcgcttcatcggccgcaagatgtctgaggtcgactacgaggccaagcaagtctcgtacggcgttgtcaaaggcgagaacggcaacgtcaaactcgactgccacgctattggcaaacagtttgctgccgaggagatctctgctcaggttttgaagaagtttgttggatgaagcatctaaatttcttagtgagaaaataccaaaagcgtggttacagtacctcccatacttcaatgattcacccaggaaggcaactcaagatgct

SEQ ID NO: 88342 - protein, 190 aa, Zea mays
  misc_feature: Ceres CLONE 1575642
MASFTCSQVGAAAAGGTSPFLGYRRRSGPGGAIPSSSLFVGRRLAAVRMRAPSRGVRGGSALRVTCEKVVGIYLGTTNSAVAAMEGGKPTVVTNAEGARTTPSVVAYTKTGERLVGQIAKRQAVVNPENTFFSVKRFIGRKMSEVDYEAKQVSYGVVKGENGNVKLDCHAIGKQFAAEEISAQVLKKFVG

SEQ ID NO: 88343 - DNA, 1333 bp, Zea mays
  misc_feature: Ceres CLONE 1575646
  misc_feature: Encodes the peptide sequence at SEQ ID NO. 88344
  misc_feature (1251)..(1251): n is a, c, t, g, unknown, or other
tcatctcgtcgcatcgactttcctcctcccccctctcgctgtgccgaattctgccccccctctctaactggtactcccctcagtggcgcgcgctcttgaactagtggatcccccgggctgcaggaattcgtctcacccctagaaaaagcactcgcggacagctgccaatcaagcgttcccctgggtgtgatcgcgatggagtccaccgagcaacaggagccagaggcgtcgccggagatcatcttccgggcgaagctcccggacatggacttcaccaagagccaaccgctgcaccgctactgcttctagcggctccccgaggtgggcgagaggccctgcctcatcgacggcagctcgggcgccttgctcacgtacgccgaggtggaccgcctgacccggtgcctggtcacatctctccggcgcggagcgtttatccccaagtgtagcccaccggcgatgaaccccacccccaacccggcggagttcttgtctccccagcttctgcgctgtcacgcatgggcgacgcaggacaccagctgccaaccaccaattgtcttacgccgccttgaagatgtgcccggccagatctgcggggcttccgtgtgcctacgtattgtggttctaccgaaagtccgtggggcttgcgggaactatgtctccccccgtcctatggggtgaccacccctagctccatgtgggtacccctctccgcttgacatacgatggcagtccatctggaacagggcgtggcccctcccaaaatgctgctgtgtttgaagaaacctgtctatggtgcagacaaggggtgtgtccaccctgcgacccttaatgtgaagaggtctgtgacgttttgtacacgcggcgccattactggataaccgggcctgcatgtctcgagcgtatccccgctggccgaactcttgtcgggtatccccccccggcatacttaaaaagtgtgtgttgtgtataaacgtcgcgagtcactccgtactattcttgcgcgactcgatgatacaatgagagggagtgttccttggcgcgcatatatcgcgatactgggagatttgcctgtaaaatatcgatcctgtgatttataccctgtgatgtctacatgttcaacactggttggtgtgtgttctcaagctaggcttctccgtcctgtactaaacttccatgggatatctcgatcgcctttgaatcacacctcttacatatcgagggctaccgttcgtatatctcccgctatcacancctggtgtccacctttgttttgtgtgcctcttaaatactccatctctaccactgttaggggaccactcgtctgatgagtgtt

SEQ ID NO: 88344 - protein, 37 aa, Zea mays
  misc_feature: Ceres CLONE 1575646
  misc_feature: SWISSPROT Homolog: EC 6.2.1.12 4-coumarate--CoA ligase
MESTEQQEPEASPEIIFRAKLPDMDFTKSQPLHRYCF

SEQ ID NO: 88345 - DNA, 850 bp, Zea mays
  misc_feature: Ceres CLONE 1575647
  misc_feature: Encodes the peptide sequence at SEQ ID NO. 88346
ctggagctccccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggttgggaaggggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaagggttctaaatcttttgaaaaagccccagcagcaggattcaccgaaaagaatgggacgccgggtggaaatatggggagactgtttcaaaaaagggatcttggttttggctctgaaattcgaaatctgccccggggggaaaactcccagaaaaaattttcgcgcaatggaaaaccaccgggtattcttgggtttgtccaacaggatttccccttggaaattttgcaacctccgggggtttggaattccccaaaaacactcaaggtgggggttgtgttatgccccc

SEQ ID NO: 88346 - protein, 149 aa, Zea mays
  misc_feature: Ceres CLONE 1575647
  misc_feature: SWISSPROT Homolog: EC 1.1.1.86 Ketol-acid reductoisomerase
MAAATSSSTYLAIGRKTLSPAPSVATAATSVSFPATQHPCLVAASADRRRAVAAKVSSPSVIGTAMPSLDFETSVFKKEKVSLAGHEEYIVRGWEGDLFPLLPEAFKGIKQIGVIGWGSQGPAQAQNLRDSLVEAKSDIVVKIGLRKGF

SEQ ID NO: 88347 - DNA, 782 bp, Zea mays
  misc_feature: Ceres CLONE 1575649
aaagctggagctccccgcggtggcggccgctctagaactagtggatcccccggggctgcaggaattcgtctcacccctagaaaaaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaattttctttattttttttccccccaccttctcccaggtgctgttggtgccccaggtggaggcaactgggcaaagttgtgccgttctttccttcaaccactaagttaaggcattttcttgcccccgggttccccgaatcagggttggggaaacaaatcccaaaaaacctggaccttccctttttcccttccaaaaaaaaaaaaggggggggggggaggggaattttttggagggggacccggtttgcccccccgaaggggggggaaaaaaaagggggggttttctcgggaaaaaaaacaacgggctcctgggggggtgccccggaaaaaatttgtgaaaaaggggggggggggggtttccgggggggggggggggcgccacacatttttttcccccgtgggtcgccccgcagggggggtataaaaaaaaatttttgtgggccccggcgggttggaggaagaacgatagttgg

SEQ ID NO: 88348 - DNA, 893 bp, Zea mays
  misc_feature: Ceres CLONE 1575650
  misc_feature (363)..(363): n is a, c, t, g, unknown, or other
  misc_feature (442)..(442): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (656)..(656): n is a, c, t, g, unknown, or other
  misc_feature (744)..(744): n is a, c, t, g, unknown, or other
  misc_feature (746)..(746): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (884)..(884): n is a, c, t, g, unknown, or other
aagctggagctccccgcggtggcggccgctctagaactagtggatcccccgggctgcaggaattcgtctcacccctagaaaaaggccacaattccaacccaagctctaacctacgacctccgccgattccgctcgcgtctgcctccgccctccgcccaaaacccaatccagggccaggccaggccaggccaaccaaaccctaggcactgcgccacgcctagcgcgcgtggtatccatgggctgaccgcgtcccggtggggagcccggatccggagctagggttccgtcctaggcggcaccaccatggagtgggacagcgagtccgacggcgccggcagcgtcgacgccggctatgagggacangaggaggaggaagaggagcggggaggcaagggtttaacccccccccccccggggggggggggggggagggcccccgggntcgcnntcccnccgcctgcgtccgccgcttgggggggccggtcgtgtggtgtttgggccttccttgtttggccgcaaaggcgagagtcgaacccccaataataacagcatatttgcaggggggtagtccacctccaaccgcgcgggggtgagagccggagcgtttcagcgaaccgcgggggtgcgctaggggggccaactacaccacactattngatacggagtggtgaggatacaagacggggtagcggtaatcacaccgcgatgtggtgggggacgcaacagccgaaaatacggggtggngnagnnnnncaacgggtacgaagtgatgtaaagaaaaataggtgaggaaagttgatctgtggtataggcgccaagtgtgtgagggttgacgggcgtacgcgtgcttacgggtaaaaaggacgccagagtaacacaagagnttcccactc

SEQ ID NO: 88349 - DNA, 943 bp, Zea mays
  misc_feature: Ceres CLONE 1575651
  misc_feature: Encodes the peptide sequence at SEQ ID NO. 88350
ccccgcggtggcggccgctctagaactagtggatcccccgggctgcaggaattcgtctcacccctagaaaaaattggctattagacttcatgccttgtcagggtggttttttaattggtaatgtcagtcctgccaggatggacttccaatggttcgcacttggaaacatgattgctatactttcttcccttgcaacacctgaacaatctgttgctataatggatcttattgaggagcgttgggaatagctcatcggcgaaatgcctctgaagacatgtcatcctgctattgagaaccatgaatggcgaattgtgacgggctgtgatccaaaaaatactagacggagttatgataaaggaagatcatggccagcaattctgtggctactgactgcagcctgcatcaaaactggacggccacaaatcacaagaagggcaattgacctagcacaaaggaggctgttgaaggatggctggcctgaatactatgatgggaagcttggtcggtatgttggcaagcaggcgaggaaattccagaccaggtccatcgcggggtatttgatcgccaagatgatgttggaagatccttcacatctcggcatgatctccctggaagaggatagggcaaggttgaagccctgctttgaaagggctgcgtcatggacaaactgagatggccacgaaaatttttaagggaagaaagtctgcggaaaaacacgagttcttgggggaagcatctccctgtctgctaaccggtttcctttgacttcaaaaataaatggattggggccttctggattttccttgggaaagtcaaaccccgtagtcgtttttggaggttaaagaaaaagaacaacgtgcgtatagtggcatttcgggttcatcttccgcaaaccctagaaaaaagaaaatatgtatgtgtgcctgggaacatccaaataacg

SEQ ID NO: 88350 - protein, 52 aa, Zea mays
  misc_feature: Ceres CLONE 1575651
MPCQGGFLIGNVSPARMDFQWFALGNMIAILSSLATPEQSVAIMDLIEERWE

SEQ ID NO: 88351 - DNA, 948 bp, Zea mays
  misc_feature: Ceres CLONE 1575656
  misc_feature: Encodes the peptide sequence at SEQ ID NO. 88352
aaagctggagctccccgcggtggcggccgctctagaactagtggatcccccgggctgcaggaattcgtctcacccctagaaaaaacatttcggaagctagctagctctgccctctgctcggggctcctccttcccagtaacaactaacaagtctacacacaggggacaccacaagtacatcgccaccgacggaggaggaacaacaagaaccccgatgacaattgcagccgcggtgaccgcgcccacgtccgcgccagtgcacgtcgcgccgcgccacgccagccccgcggtccagccgcgcgccgcgccgcgcagggagccgtcgccgctcaaccccaacgcgccggcgcaggcgctccgctccgccagccccgggcggcggcgggtcttccgcggccacggacggcgccagggctcacatcgccaaccttgacaaggtgctcgggaagccgccgcaggtgccgaggcccgcgagccacgccgccgccagcaggcagggccagggccaggggcaggacggcgagcaggagccgctcaacgtccggcacggcctgctcaacgcgctcaacctctccttcttcgtgcccatgcccgggatgcgggcgcggacggccgccgacgagcacatgtcgccgcgcagcctcatgcacatgcagcagctcctctccgccgactccccgcgggcctccccgcggtgcaccatcgcggcgcgctggcgcagcctccaccggggaggccggctggggaaggccttcctcgaccgcttgaactccgacctccggcgccgaagctcctccgctaacggggacttccttgcaagccggcgtacaaggcctttccaactggcttgcccacccgggtgggggaaaggaccgcggaccttcatgtttccccgaaccgcgtctatacggccccaaagggaaaccttctttggcaacctcgcggggg

SEQ ID NO: 88352 - protein, 120 aa, Zea mays
  misc_feature: Ceres CLONE 1575656
MPGMRARTAADEHMSPRSLMHMQQLLSADSPRASPRCTIAARWRSLHRGGRLGKAFLDRLNSDLRRRSSSANGDFLASRRTRPFQLACPPGWGKGPRTFMFPRTASIRPQRETFFGNLAG

SEQ ID NO: 88353 - DNA, 887 bp, Zea mays
  misc_feature: Ceres CLONE 1575657
  misc_feature: Translation starting site: 410
  misc_feature: SWISSPROT Homolog: EC 5.4.2.1 Phosphoglycerate mutase
tccccgcggtggcggccgctctagaactagtggatcccccgggctgcaggaattcgtctcacccctagaaaaagttccatccccccccattggtcgcgaatagttcttcttgtttacgcaaaggcaaaagcaggagcaaaaaggtttcgttggcgattgcgagcacatggacgcttcctgacacaatctaagctccccaaggagaagacagcggctcgttgtcgtgttggaccgatgggggcaggactaccccgacacagaacaactggatccgagtccctcacactcctgtcgtgcactcgttaaagaataggtgctcctgataaatggagactagtgatacgctcatggaacagctgtgggactcccatctgatgatgacgatgggacaacacccaacaacgtcacaatgtacttggtgctggacggattttcgcccaaggtgctaagcttgttgcatcgagctcttgcctcaggaaagatttatgatggcagatggggttcactacattcgaagaatctgttgaaaatggtactcttgcaccttattggggttgacaagtgatcgtggtgtccactccagccttgaccaaatacagttactaatgaaaagtgtcggggagacaagaactaaaaaattggtgtgcacatcctgtacctatggggcctgaagttttggatggagagcgtgatggttttcgggcagaccctgcagaacgatcttttggagctgctacggcatggtaatagatggccaaatttgcctttagtttcctgaaaggaagaatggttaccctggggcccgttctttaaagggaactgggatgttgaataaaaaaaagttctgggtatacctaagggtgtattacccagaaattacccgttca

SEQ ID NO: 88354 - DNA, 905 bp, Zea mays
  misc_feature: Ceres CLONE 1575661
  misc_feature: Encodes the peptide sequence at SEQ ID NO. 88355
  misc_feature (750)..(750): n is a, c, t, g, unknown, or other
  misc_feature (757)..(757): n is a, c, t, g, unknown, or other
  misc_feature (758)..(758): n is a, c, t, g, unknown, or other
  misc_feature (808)..(808): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaaaggcggacgcgaacaaacccccttattccatagcgagcgcgagcagcggcgccgggaggacgaggactgctgcgatggggggagacgccagcaccatcgagggggggccgctcccgcatctcggcggccggccggcctcccgcgtgcccgacaccccgctggtgcgcacggcgggggacgccgcgcgcatggtctgggacgagtccaagcgcctctggggcatcgggctgcccatcgccgtgggcatgctgagcatgtacgccatcagctccatcacccagatattcatcggccacctcggcaacctcccgctggccgccgcctccatcggcctctccgtgttcgccaccttcgcgctcggcttcctcctcggcatgggcagcgcgctcgagacgctctgcggccaggccttcggcgccggcgaggtcgccatgctcggcgtctacctgcagcggtcttggatcatcctcgtcgccgcctgcgtcgtcatgacgcccgtcttcgtcttcgccgagtcgctgctcctgctcatcggccaggacgccgacgtcgcgcgggagtccgccaggttcgccacctacatcgtcccctccatctacgccatgggcatcatcttcgccgccagctagttcctcaggcgcagagcatgtcaccgtacccgcctggatcggcttcngggcgcnntctcgctgtgccctctcaactacctggtcgtcagcgtgctcggctggggnctccccggcgccgccgccgcctangaattcgggcactggatcatcgcgcctccgcccagtcgtccaacatctccgatggtccaagaacggattgtaa

SEQ ID NO: 88355 - protein, 184 aa, Zea mays
  misc_feature: Ceres CLONE 1575661
  misc_feature (53)..(184): Pfam Name: MatE Pfam Description: MatE
MGGDASTIEGGPLPHLGGRPASRVPDTPLVRTAGDAARMVWDESKRLWGIGLPIAVGMLSMYAISSITQIFIGHLGNLPLAAASIGLSVFATFALGFLLGMGSALETLCGQAFGAGEVAMLGVYLQRSWIILVAACVVMTPVFVFAESLLLLIGQDADVARESARFATYIVPSIYAMGIIFAAS

SEQ ID NO: 88356 - DNA, 1014 bp, Zea mays
  misc_feature: Ceres CLONE 1575664
  misc_feature: Encodes the peptide sequence at SEQ ID NO. 88357
  misc_feature (950)..(950): n is a, c, t, g, unknown, or other
ctagaactagtggatcccccgggctgcaggaattcgtctcacccctagaaaaagtctagcagcgtcggggtcacccattctctctcgggcagcgcatcgctccggctcccatcgcaatctatccatgccgtccctaggcgcgcttgagctatgcggctctgcggcgggcttccactagagggaaaagcgtgtatgagcccagtgaggagaggtagtggaggttatgggagtgagaggatgaggatcaactgctgcagcatcacgcgctacagagcactgatgagagatgtgtttcattgcaaggggtgctgtgagcggcacagggtgcgcgctcacatcagatgccggccaagacagtcttgtcctccaaccacccccccggaggaattatggtgatcctacatgaagtcgctgccgtctctttcagtggtggtaccaggactcaagttttccgcctcccgaggacaagggtccacccctggtgttcctatttggaagattttccagagcttcttgttgtacccttgatggactgattcctaccgtgggcatttaacgagaatatgtggttgtgggcttcgcggcgcctctgcctttctctttaaccggtcacacggccctccctagggtgttttatggtgggggggggaatttactttcactcaagggttccctcactgggtctggcttcgggctcccatagccgtattgccttttgggaaggcccgcttaccttggttatcctagccctcttggctaatggcccaattcttcatgttattacctgaagacctgtatgctttatgtgatacctttattcgcgccatcataagaaaattgctcaatggtggctcggcatatttcacctcctagaactcccgtactccagtcagaaaaggtgggagagagatgcgcctataacaattgggcgggataggtgttcgcgtccnctcgtggttgtgaaggcggagaaccgccttcttgtttctaaatgggaccaacaggctgccggcc

SEQ ID NO: 88357 - protein, 81 aa, Zea mays
  misc_feature: Ceres CLONE 1575664
  misc_feature: SWISSPROT Homolog: EC 2.7.7.27 Glucose-1-phosphate adenylyltransferase
MRLCGGLPLEGKACMSPVRRGSGGYGSERMRINCCSITRYRALMRDVFHCKGCCERHRVRAHIRCRPRQSCPPTTPPEELW

SEQ ID NO: 88358 - DNA, 931 bp, Zea mays
  misc_feature: Ceres CLONE 1575666
  misc_feature: Encodes the peptide sequence at SEQ ID NO. 88359
  misc_feature (826)..(826): n is a, c, t, g, unknown, or other
  misc_feature (898)..(898): n is a, c, t, g, unknown, or other
ctggagctccccgcggtggcggccgctctagaactagtggatcccccgggctgcaggaattcgtctcacccctagaaaaacccctagaaaaatagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatcaagatgaaggagattgctgaagcctaccttggttccaccatcaagaacgcagtggtgacagtgccggcctatttcaacgactcgcagaggcaggccaccaaggacgccggtgtcattgcgggcctcaatgtgatgcgtatcatcaacgagcccactgctgctgctattgcctacggtcttgacaagaagggcaccagctccggcgagaagacgtgctcatcttncgacctggtggtggcacgtttgatgtgtcgctcctcacatcgaggagggcatctcgaggtgaaggcactgcnggcgaactcaccttgggcgcgaggactcgacat

SEQ ID NO: 88359 - protein, 237 aa, Zea mays
  misc_feature: Ceres CLONE 1575666
  misc_feature (8)..(237): Pfam Name: HSP70 Pfam Description: Hsp70 protein
  misc_feature (203)..(203): Xaa is any aa, unknown, or other
  misc_feature (227)..(227): Xaa is any aa, unknown, or other
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFKVIPGPGDKPMIVVNYKGEEKQFAAEEISSMVLIKMKEIAEAYLGSTIKNAVVTVPAYFNDSQRQATKDAGVIAGLNVMRIINEPTAAAIAYGLDKKGTSSGEKTCSSXDLVVARLMCRSSHRGGHLEVKALXANSPWARGLD

SEQ ID NO: 88360 - DNA, 694 bp, Zea mays
  misc_feature: Ceres CLONE 1575670
  misc_feature: Encodes the peptide sequence at SEQ ID NO. 88361
  misc_feature (326)..(326): n is a, c, t, g, unknown, or other
  misc_feature (355)..(355): n is a, c, t, g, unknown, or other
  misc_feature (483)..(483): n is a, c, t, g, unknown, or other
  misc_feature (487)..(487): n is a, c, t, g, unknown, or other
  misc_feature (488)..(488): n is a, c, t, g, unknown, or other
  misc_feature (522)..(522): n is a, c, t, g, unknown, or other
  misc_feature (523)..(523): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
aaagctggagctccccgcggtggcggccgctctagaactagtggatcccccgggctgcaggaattcgtctcacccctagaaaaaaaaccctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaagggaagggcaataagaangagtttgtgagggctgagtcagaaggagntgagatgatgccctgagttttgtgggcgacaaatgcatctccttgtatcggttaggggcccttaattgggggaaccttaaattttccccttccgggatgaattaaaaagagaaattctctcccctttnttgnnggggggcccccccccaaaaaaaaggggggggggnnttttttttgggccgggggggggccccctccgggggggggttttttttcaaaaaaaaaaacccccctgtttggccccccccaaaaaaaaaacgcgcccccaccaaagagggggagaattttttttttggggcccccccccggggggaaaaaaannnaaaaaaaaaaaaaaaa

SEQ ID NO: 88361 - protein, 50 aa, Zea mays
  misc_feature: Ceres CLONE 1575670
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSREGQ

SEQ ID NO: 88362 - DNA, 952 bp, Zea mays
  misc_feature: Ceres CLONE 1575671
  misc_feature (461)..(461): n is a, c, t, g, unknown, or other
  misc_feature (494)..(494): n is a, c, t, g, unknown, or other
ctggagctccccgcggtggcggccgctctagaactagtggatcccccgggctgcaggaattcgtctcacccctagaaaaaagatacatggccggccatctctgagccggtctcccggcagcagcagtccctcgggttgtccacgcggagcgccagccgatggccggccacagtatgtcggttcacccgaagcctataaattcctcgccgccccgcctctcgccgccccgcctctcgccgccccgcctctcgccgcccatttccctccgccgcctcctaatcctcaacacccgcgcccccaaccgcgcccgtcgtatgccaccatgcaccgcgcccgccccaccgcgcacgctaatgaccccgatgctccgtacgccgccgccgtcgcgatgctgctggagcccaaactcgaggacgaggagttgccgctgcagcagctggcgtccccgggccccttcgtgntcctggacagctgattgctggcgtggccgtgcnggccgaaccgcgcccgctggaagcgctgctgcaaggccgcagctgccgcccttcctgtccagacgtacgacctgttgaactacccggccgctgaacggggtcatcccctggggcggctgcggaaaaccttcccctgggtgggacccttcaactttgggggggaatggggggccgaaaattcaaagacaaaatttttcccaagttgggggggagctaaaacacttgggtttcccaagggtcttgcgaaaaaatggggatttgcccccaaaaatttcccggggaaaaacaaccccttttggaaaaaggttgggggggggggccccccccaaaaaaaaaaagagggtgccgcggggccttttttggaaaagccaccgtggccccgcccccccccccgaagaaaaaaaaaaaacccccttggaaaaaaaagggggataaaaaaaccccccctaatttttata

SEQ ID NO: 88363 - DNA, 970 bp, Zea mays
  misc_feature: Ceres CLONE 1575674
  misc_feature: Encodes the peptide sequence at SEQ ID NO. 88364
aaagctggagctccccgcggtggcggccgctctagaactagtggatcccccgggctgcaggaattcgtctcacccctagaaaaaattccccacgtactctctcggctgctcgcttatggcgatcgaagctgcgcgcctctcaccgtccatcgccgccgccgccttcctcgccagccgcccccctcttgccctccgcccgttctcccttcgtcgcaggtttcccctcctccgcgtcctcgccaactcatcgggaggggacggacgcgtcgtcgctctgtcctcgtctgagctccgaaagcgccgaggcctgtcttcctcctctggggctgcggactccgcatctgacggggatgagaagctacgctcgcttcgtcgactcttcgcgcggcccgacgttgctattgacgcctacatcgtcccttcacaggacgcccaccagagcgaattcattgcagaatgcttcacgaggcgtgcctatctgactgggttcactggcagtgctggtacagctgtggtcacaaaaaataaggctgctctctggactgatggccgttattttcttcaggcagagaaggaattgagccaccactggacactcatgcgcagtgggaatcatggtgttccaactactagtgagtggttgaatgatgttttaccatctggttgccgagttggtattgatccgtttcttttctcatttgatgctgctgaagaactgaaggatcaatcgccaataagaacatgagttagttttggttcagggcatgaacctagtgatgaaaaaatgggggagatgcaagggccaatcccccaaaagaccaactagggtgcatgacatcaaaatggctggtatgatgtgccatcaaaagtgtcctccataggtcacactggctgaaaagggtgggaatgctggggtattccatgctcgagaaagttgctggtggtggaaaaggaaagaatgatgcccacc

SEQ ID NO: 88364 - protein, 209 aa, Zea mays
  misc_feature: Ceres CLONE 1575674
  misc_feature (81)..(210): Pfam Name: Creatinase_N Pfam Description: Creatinase/Prolidase N-terminal domain
MAIEAARLSPSIAAAAFLASRPPLALRPFSLRRRFPLLRVLANSSGGDGRVVALSSSELRKRRGLSSSSGAADSASDGDEKLRSLRRLFARPDVAIDAYIVPSQDAHQSEFIAECFTRRAYLTGFTGSAGTAVVTKNKAALWTDGRYFLQAEKELSHHWTLMRSGNHGVPTTSEWLNDVLPSGCRVGIDPFLFSFDAAEELKDQSPIRT

SEQ ID NO: 88365 - DNA, 962 bp, Zea mays
  misc_feature: Ceres CLONE 1575675
  misc_feature: Encodes the peptide sequence at SEQ ID NO. 88366
  misc_feature (849)..(849): n is a, c, t, g, unknown, or other
  misc_feature (886)..(886): n is a, c, t, g, unknown, or other
ctggagctccccgcggtggcggccgctctagaactagtggatcccccgggctgcaggaattcgtctcacccctagaaaaaagtcatagaacggggttgcgaggtagcccaattctacagcactagtctttttcgtctcggtcgccatgtccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcatgtgaccgaggactcccagccgcagctgctgaagctcatcgacgccctccagcccggcggcaacaccaacatcagcgacggcctccagacggggctcaaggtcctcgccgaccgcagctcagctccggtcgcgtcgttggcgtcatgctcatgtccgaccggcagcagaacgggggcgagccagcgncaacgtcaagatcggcaacgtgccggtgtacaccttncggggtcgcgcggactacgaccccagggtgctgaacgcggtggcaggacagcatgggagggacctcttccgtcgta

SEQ ID NO: 88366 - protein, 180 aa, Zea mays
  misc_feature: Ceres CLONE 1575675
  misc_feature (28)..(178): Pfam Name: VWA Pfam Description: von Willebrand factor type A domain
  misc_feature: SWISSPROT Homolog: EC 6.6.1.1 Magnesium chelatase
  misc_feature (156)..(156): Xaa is any aa, unknown, or other
MAPLEENTQKVLLELTGGDSTSDRSGLDLVAVLDVSGSMQGEKIEKMKTAMKFVVKKLSSIDRLSIVTFLDTANRICPLRHVTEDSQPQLLKLIDALQPGGNTNISDGLQTGLKVLADRSSAPVASLASCSCPTGSRTGASQRQRQDRQRAGVHLXGSRGLRPQGAERGGRTAWEGPLPS

SEQ ID NO: 88367 - DNA, 939 bp, Zea mays
  misc_feature: Ceres CLONE 1575677
  misc_feature: Encodes the peptide sequence at SEQ ID NO. 88368
  misc_feature (815)..(815): n is a, c, t, g, unknown, or other
ctccccgcggtggcggccgctctagaactagtggatcccccgggctgcaggaattcgtctcacccctagaaaaaactcccgaagagtcgctctcctgcgtccacgcctcgcttgcggcgactagggcgactgccgccgccgcccttcgcccagctgcccaggtcttcgtcgggcgctttaccggtgaagagcgcccaccataccaggccccgcaccttttaacaagttccagtcgtggcgccgagccctactcctcctcccgccgccgccgccgccgccgcagactcttcctcgcgactcgccgctcgcccgactttccgagctccgacaccaaggtctgagtgtctgactaccacgctgcacctacgacctcgaggcgtctccaccgcgccattggcaaactaactcactttacaggagcaccatgggagagtcgagcaaggagctcctggacctgccctccgaccccaggcctcccgcctccttcatcgagtcgcttctcgctggcagggagcagcagcagcaggataaggagggaaatcgtaagttgggggcgtccactgatcccctgcccaaaagccaaggtactgttgaactagctcttcagcttgtacaagtgtctgatcagaaacgcggtaaggccgtaagggggctaaatagaagctcgaaatctttctagcggcacaatatagataaataatgatatcaatttcattgcctgcagtcagaaaatcataatgctacatgcaactttaagcagttattaagtctaaactaagcagggccacttaaaaaagggtgcatacccagtgccnggagcttgtacatacagggatctaggaactgagggcagatttctctcacgactgcaccagtcctacctttcagcagggacacttaccagaagtttttttttcccatgttgcagtcagcaactgg

SEQ ID NO: 88368 - protein, 84 aa, Zea mays
  misc_feature: Ceres CLONE 1575677
MGESSKELLDLPSDPRPPASFIESLLAGREQQQQDKEGNRKLGASTDPLPKSQGTVELALQLVQVSDQKRGKAVRGLNRSSKSF

SEQ ID NO: 88369 - DNA, 927 bp, Zea mays
  misc_feature: Ceres CLONE 1575679
  misc_feature: Encodes the peptide sequence at SEQ ID NO. 88370
  misc_feature (689)..(689): n is a, c, t, g, unknown, or other
aaagctggagctccccgcggtggcggccgctctagaactagtggatcccccgggctgcaggaattcgtctcacccctagaaaaaatttccatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggatgggataggtaagagcaacggtggtgggaagagagatgatagacacaggatgcggcagtacaggtcgcagctcgaacaggaggtcaagaaattgcagaggcagcttgaagaagaggttgatctgcacgtggcgttggcggatgctgttacacaaaatgttgcgcctatactgaagtcttctatgaangctccacacaaggcacaagagctactgattaacatcgccttcctgggagattacgggtttcaaacctggaaagaagctaaatgatctgtactaccagctttggtccgaaaaggacgaaaggtacttgctgaaaaatatcagggaggcttgcatctacctcccccgaagaacaccgttcattggcaattggcccgggtacctgggaagagacactttctcggttgagagatgtgaattg

SEQ ID NO: 88370 - protein, 163 aa, Zea mays
  misc_feature: Ceres CLONE 1575679
  misc_feature (136)..(136): Xaa is any aa, unknown, or other
MTCVRAEDAVSPAAADDVAAALVSRGGLIQKVAAGGGRRPAGSARSLQRSAHLATGDGNAPAPAVEASCSWSGDGIGKSNGGGKRDDRHRMRQYRSQLEQEVKKLQRQLEEEVDLHVALADAVTQNVAPILKSSMXAPHKAQELLINIAFLGDYGFQTWKEAK

SEQ ID NO: 88371 - DNA, 820 bp, Zea mays
  misc_feature: Ceres CLONE 1575683
  misc_feature: Encodes the peptide sequence at SEQ ID NO. 88372
tggagctccccgcggtggcggccgctctagaactagtggatcccccgggctgcaggaattcgtctcaccccgaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtctccaagtctgacaagattgttgttgagaagtccactgtccctgtcaagaccgctgaggctattgagaagatcttgacccacaacagcaagggcatcaactaccagatcctttccaacccagagttccttgcggagggcactgccattgaggacctgttcaagcctgacaaagtgctttatcggggcccgggatacccctgaggggcgggaaggccgtcccagctcctct

SEQ ID NO: 88372 - protein, 182 aa, Zea mays
  misc_feature: Ceres CLONE 1575683
  misc_feature (2)..(182): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDKVLYRGPGYP

SEQ ID NO: 88373 - DNA, 960 bp, Zea mays
  misc_feature: Ceres CLONE 1575684
  misc_feature: Encodes the peptide sequence at SEQ ID NO. 88374
ctggagctccccgcggtggcggccgctctagaatagtggatcccccgggctgcaggaattcgtctcacccctagaaaaagcaccacacggcacctggcactgccagcctcgtcgcgcacggcctatatatccccagtctcttcatctgcagcgacaaaaataggaaccgagcaaaggtctggcgagctaccaataaactaccatctccacaaacaggccagcacgtagctatatgccagaactgacctagctagtagaggatcgatcgcagatggtgtttcctgccatcctccccaaggtggccgcacgatggctcttcacgttctaccgcgccgccagaaagctcaggcgccacgccttccagctctactaccgcaacactaccgccgccaagccgtcgtccgccgccgccgccgccgtctcgcagcaacagaccggggccgccgccactgccgccttgaagaccggggccgccatccctgacgccgccggccggaccgttgtgtgcgagatgcacggcgccctgctgcgctccaccgcgctcttcccctacttcatgctcgtggcctgcgagggcggcagcctcgtccgcgccatgctgctgctctgcgccttccccctcgtctgggcgctcggggagcgccgcggcgccggcgtccggggtgatggcggtcgtcaccttcgcggggctcaggcccaggtacgtggacctcgtgggccgcgccgtcctgcccaagcactacatggagcagctcagcgcgctggggtacagcagcctctgggtcccggccagaaggaaagtggcggtgccaacgcgccccgggtcatgtccaaatgttcctccaggaatacatggcccccaaacccgggggcggggcctaagcttgaacacgttaaatgcggccggcgcccggacttcactggggttgcgcccggcgcccggcacccccaagggaaaga

SEQ ID NO: 88374 - protein, 229 aa, Zea mays
  misc_feature: Ceres CLONE 1575684
  misc_feature: SWISSPROT Homolog: EC 2.3.1.15 Glycerol-3-phosphate O-acyltransferase
MVFPAILPKVAARWLFTFYRAARKLRRHAFQLYYRNTTAAKPSSAAAAAVSQQQTGAAATAALKTGAAIPDAAGRTVVCEMHGALLRSTALFPYFMLVACEGGSLVRAMLLLCAFPLVWALGERRGAGVRGDGGRHLRGAQAQVRGPRGPRRPAQALHGAAQRAGVQQPLGPGQKESGGANAPRVMSKCSSRNTWPPNPGAGPKLEHVKCGRRPDFTGVAPGARHPQGK

SEQ ID NO: 88375 - DNA, 944 bp, Zea mays
  misc_feature: Ceres CLONE 1575686
  misc_feature: Encodes the peptide sequence at SEQ ID NO. 88376
ctccccgcggtggcggccgctctagaactagtggatcccccgggctgcaggaattcgtctcacccctagaaaaagaggatccccagttccccaacctctcttgctcgctcccctcccacagtcacacactcgtctcgagcgccgccccaaacccccaacccccaaccaaaccctcgccgccgtcagcagccatggatcttcgccgcccgccgcgctcctcgtcgggcggcgtggagcccaagatccgccaggtcggcttcttcaccccggatgcctccgcgccgtccgagcccctgccccccgccgcggtggtccaggcaccatcggcgcagcagaggccggtcacggcgtcgcctccggcgtcagacgacttctcccaggggcgcctttcccctgtcatgatccctcccccgcgccatgccgaccacctcgccctgggcccacaccccccggcggcggccgacgtcgtcctcgccacttctgcgcccgtgcgttcgtccccgcgcctcgacatcgtgtccgagatcggcgacgacgactcctggtcacgcgctccttctgctgtggagctagaaaaaaacaagcgtggtttggctgaaatacggaatgggggagctccagcttccattcccaaaagcagaaaacctcgaaagcagagagacttgcaattcaggaagccccacgtgctgctaaagctgcagcgaagaagcagataatccagaaaatctgctggggctgcgatgtccaagcaagcaagccagcaaaactggtcagaagaagatggccccaagctgcagtacactgcttctgaaaaaaggcctacggaacgcctccaaaaaagaaaaaaataaatgctcccatcccccaggcgttgatgatggcttagggggaaaagcaaaaaacggggggggccaccatctaaacccaaacaaagtaactgttcg

SEQ ID NO: 88376 - protein, 174 aa, Zea mays
  misc_feature: Ceres CLONE 1575686
MDLRRPPRSSSGGVEPKIRQVGFFTPDASAPSEPLPPAAVVQAPSAQQRPVTASPPASDDFSQGRLSPVMIPPPRHADHLALGPHPPAAADVVLATSAPVRSSPRLDIVSEIGDDDSWSRAPSAVELEKNKRGLAEIRNGGAPASIPKSRKPRKQRDLQFRKPHVLLKLQRRSR

SEQ ID NO: 88377 - DNA, 949 bp, Zea mays
  misc_feature: Ceres CLONE 1575689
  misc_feature: Encodes the peptide sequence at SEQ ID NO. 88378
ctggagctccccgcggtggcggccgctctagaactagtggatcccccgggctgcaggaattcgtctcacccctagaaaaattttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgcgcgccgacgccggcgacgtcgtcgtcgagctcccggggttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcctggctcctgcgccgctggaaggacgcgctgggggtgctccactccacggggcaccacgccccgttctgcgaggacctgggcctcacgtcccgctgcgtcaacgccgtggccgccctccgtcgcaggccgggaaccggcccgaacctcacttccggcgtccccctggtggggcgcccaagtcccccaaactcggggtcgacctcttctggcggataatggtccccgtaaaggcaacgggcgccgcccccaaaaaacgtcggcaaccccttaagggttacccgccgcggtggttgtccaaggctccagaggacaacgctttcacggaacccgcgaaat

SEQ ID NO: 88378 - protein, 199 aa, Zea mays
  misc_feature: Ceres CLONE 1575689
MKFMRLGTRPDTFFAAADSVRSVCTEVATDLQILVDNCLYHLHKFPLLSKCMLLQALRADAGDVVVELPGFPGGAEAFEACAKYCYGITITVSARNLVPLRCAAAHLGMSEAADRGNLAAKLDAFLASWLLRRWKDALGVLHSTGHHAPFCEDLGLTSRCVNAVAALRRRPGTGPNLTSGVPLVGRPSPPNSGSTSSGG

SEQ ID NO: 88379 - DNA, 848 bp, Zea mays
  misc_feature: Ceres CLONE 1575693
  misc_feature: Encodes the peptide sequence at SEQ ID NO. 88380
  misc_feature (447)..(447): n is a, c, t, g, unknown, or other
aaactggagctccccgcggtggcggccgctctagaactagtggatcccccgggctgcaggaattcgtctcacccctagaaaaaaggcaggcgcgcatccagctcctgccttgcttcctctcctcccggttcccgaataaaatttcctggacccggagcgcgcagcgcgctcccccgcctcccaaggaaacttatctaagcattccggcggtcgatccatcttcccgtccagggagagcaaggaataatcaatcaaccggccagtgaaacgttaggaggaggaggagagccggagtccgtccagcgcggcgcgggttgatcccttgcgtctccgcccctgccccgcgccggcgacacctttttgcggtgctagcgttgcgtcgaggagggacaggcgctctgcgtccttcgcacggcaacggcaagacggcggcgttgaagatgcggngtgttggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttggccgcctcctggggcggcctgcactgggagcggcagatccgtgcgtccgccgcgccgaggcggccccccgggtccgccgccggggccgggaatgtcggtgctgggcacaggaggccgcgggcttttttcgggaccccagtgctggctcggcgctccggaaggggggggaacgggggtcgggccgggagttgaatagcttgggacgggtt

SEQ ID NO: 88380 - protein, 106 aa, Zea mays
  misc_feature: Ceres CLONE 1575693
  misc_feature: SWISSPROT Homolog: EC 5.1.3.6 UDP-glucuronate 4-epimerase
MNRQLHRCFASTSTMFLWALFLVAMTASYLSFQSFVDTSSKYLAASWGGLHWERQIRASAAPRRPPGSAAGAGNVGAGHRRPRAFFGTPVLARRSGRGGNGGRAGS

SEQ ID NO: 88381 - DNA, 874 bp, Zea mays
  misc_feature: Ceres CLONE 1575694
  misc_feature: Encodes the peptide sequence at SEQ ID NO. 88382
aagctggagctccccgcggtggcggccgctctagaactagtggatcccccgggctgcaggaattcgtctcacccctagaaaaacgttcacccaccgcccggcgcccgccttgtattcgggcaaccactggggcggctcgttcgagagcccgatggggcggcggacgatgaccacagccgcaacatggacctggaccgcggcgcgctgtctgcgcggcagcaccacgagctggacgagacacagcagagctggctgctaggcccgccggaggccaagaagaaggacaagtacgtggacctcagttgtgtcctcgtctagcgcaagctcctctggtgggccttgtggtgcgtcaccgccgctttcatcctcatcggtctccccatcatcatcgccaagtccatcgcgcactagaagcaagggacgccgccgccagatcagtacatgagaggcgctgcacaaggcgctcctcttcttcgacgcccagaaatccggccaccttccctagacaatggcatcaagtggcgcgggaactctggcatgtcagacggctccgacgcctaggacgtcaagggtggcctcggcggacgctactaccacactggctacaacatggagctccactgctcgatggtcttctccatgacacgactgagctggcccggtgatcaagtacagccgccagtacacggcttggctggacgatgaccacgtcatggagctcatgatactggggcacctactatgctgctacgtaacgtcaactactcctgatgcatcatcggacaagtcataccccccacgtgggtgcctgctaagattcaccgggagccgtgcgggactaactttactggcgggaactgcccggaggtaatga

SEQ ID NO: 88382 - protein, 44 aa, Zea mays
  misc_feature: Ceres CLONE 1575694
  misc_feature: SWISSPROT Homolog: EC 3.2.1.4 Cellulase
MDLDRGALSARQHHELDETQQSWLLGPPEAKKKDKYVDLSCVLV

SEQ ID NO: 88383 - DNA, 771 bp, Zea mays
  misc_feature: Ceres CLONE 1575695
  misc_feature: Encodes the peptide sequence at SEQ ID NO. 88384
  misc_feature (339)..(339): n is a, c, t, g, unknown, or other
  misc_feature (360)..(360): n is a, c, t, g, unknown, or other
  misc_feature (368)..(368): n is a, c, t, g, unknown, or other
ctccccgcggtggcggccgctctagaactagtggatcccccgggctgcaggaattcgtctcacccctagaaaaagaccgcttcttcgcaaacctccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcngttggcttccagcactacctnggtcatgnctcggcaccacccgtcctcatcgccacccatcatcgtccccgctcatgggggcggcggccatgcccaagaagggcaatcgtggatccaaaaccatcccggtttcctttcccgggggataaaaaggcttggttgaggggcccctttttggggaggggggttccccccccccgggtaaaagggggggttccctacccccctaaattttttttcccgcggggggggggggggctcatatttcccttggggagccccccccaaaaaaaaacccccccttttccccatttaagaaaacccctcttttttaaaaaaaaaaaaaaaatttttggttttttctcccaacaaaaaaaaagggggggggcccccctcccccccgggggggggggggggggcccccctccccca

SEQ ID NO: 88384 - protein, 85 aa, Zea mays
  misc_feature: Ceres CLONE 1575695
  misc_feature (37)..(37): Xaa is any aa, unknown, or other
  misc_feature (44)..(44): Xaa is any aa, unknown, or other
  misc_feature (46)..(46): Xaa is any aa, unknown, or other
MPPVKAEDLVVHAVKEQFAGLDYCITSPPPWITTVLXWLPALPXSXLGTTRPHRHPSSSPLMGAAAMPKKGNRGSKTIPVSFPGG

SEQ ID NO: 88385 - DNA, 915 bp, Zea mays
  misc_feature: Ceres CLONE 1575697
  misc_feature: Encodes the peptide sequence at SEQ ID NO. 88386
tggagctccccgcggtggcggccgctctagaactagtggatcccccgggctgcaggaattcgtctcacccctagaaaaagactgccctcacctctcactaccaccactcactgccacggattcataccagctgcagcatgagcgcgagcgagctagcttcggtcggtcgatagatcgatcgatcgctcggccatcatgaggagcgaggagcatgcgctggtgtggagggagatcgtgaacctccgcgggaagccgacgagctcggagggcggctcgtcgggcatctctgtgcgcgtgtcccgacggctgccggacttcctgcagttggagaaccacaagtacttgcggctctggtaccactacctcatctgctacggcgtgtacctggccaccccccccttcatcttgctggtgtgcggggccgacctgggcagaacgcgatcgcgactagatatggtcccaaggtgtgggggggaggccaccctacgacttcgggaccgtggcggcacttcgtcgcccgtcctcggctttagagcgtctctatctaaaataatgtccaggcccaagggcccgtgtaccctcaatcgacttttacagggcttactagaccggccccactaaagataaaatgtgtcgcaagggcgaaagtgtcttctaccatgggcgcgcaaaattcttgcgaggttcgtactaacggaagcgcctggggcggttttattttgcggtctgggggaggcaagtttcaggtattttgccgaaaaagacctttacatggcggggccttctttggtttaaagtcccaagagccctgggggacctctccttttaagggagggccccccggcggaagccatacctggggtcatgaattgggctgtcccttggaccaaagttttttcctagagagatctctcg

SEQ ID NO: 88386 - protein, 141 aa, Zea mays
  misc_feature: Ceres CLONE 1575697
  misc_feature: SWISSPROT Homolog: EC 2.3.1.119 Icosanoyl-CoA synthase
MRSEEHALVWREIVNLRGKPTSSEGGSSGISVRVSRRLPDFLQLENHKYLRLWYHYLICYGVYLATPPFILLVCGADLGRTRSRLDMVPRCGGEATLRLRDRGGTSSPVLGFRASLSKIMSRPKGPCTLNRLLQGLLDRPH

SEQ ID NO: 88387 - DNA, 1069 bp, Zea mays
  misc_feature: Ceres CLONE 1575698
  misc_feature (397)..(397): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (424)..(424): n is a, c, t, g, unknown, or other
  misc_feature (425)..(425): n is a, c, t, g, unknown, or other
  misc_feature (435)..(435): n is a, c, t, g, unknown, or other
  misc_feature (731)..(731): n is a, c, t, g, unknown, or other
  misc_feature (784)..(784): n is a, c, t, g, unknown, or other
  misc_feature (827)..(827): n is a, c, t, g, unknown, or other
  misc_feature (857)..(857): n is a, c, t, g, unknown, or other
  misc_feature (1015)..(1015): n is a, c, t, g, unknown, or other
ctggagctccccgcggtggcggccgctctagaactagtggatcccccgggctgcaggaattcgtctcacccctagaaaaaattcccctcctggcaggcctcggagaagggtcaagccggtaggagtatttatcgccgccggcagccactttcccgcgcagcaggagaagagagacgacacagcagcttttttggtttccccttccctttccccgcgcggtgatcgctgggttctccgcgagcgaggcagggcactgcgcgtcctccgcgaccgcctggtgatcgctgggggttctggacgttggcgtttcatttggttggttggtgggtggcagcagccgtggcgagatggagctgatgctgccggtgacggtgaaggagagtggcccgcccggaanggaggaggtttcttnnnnncnnnnccnncctccgtctnttccccccctcttttgctcttgcccttcgcctctcctcttctttgtcggcccggtcctccggggctcctgccgctcgtcctctgtgcttctcgtgggcgcgggttgctctgggccgtgtccttccggctcccccgcccctggtcgtccttggcgtgggccgtcgtcggggtgggcctcttgccccgcgtgggcttcgcccttggtgtttcgcccttgcccggttgtggctcgctcgcctggggttctgcctggggcctgggccgggggtcttcttgttccccccccccccgttgcntgggccctcggggggggtcgtctgcccccctcgccccgggttgcttctgtgtngggtggggggccgccggccttgccttgctccgttgcccggccntttccccgctgcggtgccctttccgtggcnggttttgtttcctctcgtggtgggttctgcctttgtccccccggggcggctgggccgggtctcctcttttgttgctgcgtcccgggccggggtcagttggtccttccccccgttctttcaccgcccccgtggctcgccgccctcttttttgtgttggntgggcgctccccttttatttgcttgtgcccccttacgtttcacccgtcgccgtc

SEQ ID NO: 88388 - DNA, 909 bp, Zea mays
  misc_feature: Ceres CLONE 1575708
  misc_feature: Encodes the peptide sequence at SEQ ID NO. 88389
ctggagctcaccgcggtggcggccgctctagaactagtggatcccccgggctgcaggaattcgtctcacccctagaaaaagtcgccagttcgccactctctggttgctgcacgcctctagtcggcggggccaagaggtggaaaagggcaggatgaagtccggctgagcggccgaagcagatgcggggcgtccggcatgaatctcggcggttccggcttctggtcatcgtcgccggcttcttcctcgtctccctgaccttcgtcgtcatctccaagcccgattccatcctgtccagcctgaacggcaagctgccggtggaccaggcgccgacgtccatcctgatccagcagaaggttaactcgccccccgccaccacacttgagacctccaccgacgcactgcgtggagaccctagagtggtcgatgacgaagccgatccaagaccacaggggttcaagggctaggaggaagagagccgggtactgagcgagccggacgcgaccagcgggatgacggagctgacccccgacaaggacggcagcggccgtaaatccaactaggaggtgctaagcggctgaggtgaccgcgaggggaaaagtaaggaggaccgcggccacgggccggagaagcataaagtgacgctcccaaccgtttccaactacactattcatgacaccgaggacacccgatatgcccagcaagacgatacaagttatgaccagcatgggcagcagcccctgtgcgacttctcagatttcagagcaaacgtgtgcgagatgcgtggtgacgttagagttcacccaaatgctgcatcaatcatgttcatgtagcctgggcattcgcagagagatgagctgtggaaaatcgagccatacctcggcaaaggggagagttctgccttagcatatc

SEQ ID NO: 88389 - protein, 94 aa, Zea mays
  misc_feature: Ceres CLONE 1575708
MRGVRHESRRFRLLVIVAGFFLVSLTFVVISKPDSILSSLNGKLPVDQAPTSILIQQKVNSPPATTLETSTDALRGDPRVVDDEADPRPQGFKG

SEQ ID NO: 88390 - DNA, 835 bp, Zea mays
  misc_feature: Ceres CLONE 1575709
  misc_feature: Encodes the peptide sequence at SEQ ID NO. 88391
tggagctccccgcggtggcggccgctctagaactagtggatcccccgggctgcaggaattcgtctcacccctagaaaaagaataccacaccacacctcacggcgtccattcgttcccgtctcgtcttccgctgcttgcctccgactcccccacgcgtcgtctcgtgcttcccaatccccatagagccggttgatccccaaaggcccatggttttctccgacgccgcgtcgcctctcgtagccactgccgctgactctgcttcctcctgcgtcgcccacctccgctgctgctgtcgcgttagttgttgctgttgttgttgaagacgcgttgctcgctagggttcgtgatttctcgccgatcgattcgggaactggtaagctatggatctctcgcggcccgcatcgtcagacctctcgctcgggctgcactcgcatgcccacgcccacgctcgcgtgcacgcggcagccgcgccgctgcgcctgttcgacgacgcgaagccggagcgcctcgtggccggtgaggccgacgcggagagggacgacggggacgggggcgaccagcacttctccctcctcgggcactccctctgcgtcaagcgcccgcgccgcgccgtcaacgggggtggggggtgggggcggaaaaaacgtattcctggttcgtccacgtccccgggcgctggcccccatccaaacggcaaggcggccgggggataaaatacccggggcggaaactgggaaaaccccggccgggcccgagggtccgtctcccggggggtaaaccgagtatcgcggagcaggaagcccatccctcggtaggcggcctctcgccggaaaat

SEQ ID NO: 88391 - protein, 110 aa, Zea mays
  misc_feature: Ceres CLONE 1575709
MDLSRPASSDLSLGLHSHAHAHARVHAAAAPLRLFDDAKPERLVAGEADAERDDGDGGDQHFSLLGHSLCVKRPRRAVNGGGGWGRKKRIPGSSTSPGAGPHPNGKAAGG

SEQ ID NO: 88392 - DNA, 888 bp, Zea mays
  misc_feature: Ceres CLONE 1575713
  misc_feature: Translation starting site: 237
  misc_feature: SWISSPROT Homolog: EC 6.2.1.12 4-coumarate--CoA ligase
  misc_feature (562)..(562): n is a, c, t, g, unknown, or other
  misc_feature (707)..(707): n is a, c, t, g, unknown, or other
  misc_feature (708)..(708): n is a, c, t, g, unknown, or other
  misc_feature (806)..(806): n is a, c, t, g, unknown, or other
tagctggagctccccgcggtggcggccgctctagaactagtggatcccccgggctgcaggaattcgtctcacccctagaaaaactccaggagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgaacgtggtgatgagcctgctccgcaactgccccgagttcgccttcaccnttcctgggcgccgcccgcctgggcgccgccaccaccacggccaacccgttctacaccccgcacgatgtccaccgccaggcggtagctgccggcgccatgctcatcgtgaccgatgcctgcgccgtgtagaaggtgcgggaagtcnnctgcgatcggggcatccccgtggtcaccgtcgactggcgcttccacggctgcgtggagtcgccgagctgatcgccggctaagagctggaggcgactcnaaatccaccccgacgacgtcgtcgcgctgccctactcctccggaacaacggtctgcccaagggcggtctgctcacccacgcc

SEQ ID NO: 88393 - DNA, 632 bp, Zea mays
  misc_feature: Ceres CLONE 1575715
  misc_feature (44)..(44): n is a, c, t, g, unknown, or other
  misc_feature (50)..(50): n is a, c, t, g, unknown, or other
  misc_feature (82)..(82): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (473)..(473): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (561)..(561): n is a, c, t, g, unknown, or other
  misc_feature (562)..(562): n is a, c, t, g, unknown, or other
ggggggggggaatagaaagagagagaagaaagaaggagaggggncaaggnggggggggaaaacgggctcccccgggggcgcntctaaactatggatcccccggctgcagaattctctcacccctagaaaaacccaacctcatcttctctccttttgctcggaacgcacacacagcccggttccccgatctccgatcccctcgtcgatccaagaatgcagatctttcgtcaaagacccctcactggaaaagactatcaccctcaagtgggaatcttctgaacacccattggaaaaacgtcaaggggcaaaaatcccggggacaaaggaggggcatttttcccccccgggaaccaagccagcggggggcccccaaaccttttccccccggggaaaaaacaaaccctccaagaggaaaacggggggggnnnnnncnaacaaaaccttttttggccccccgaaaatttttccaaaantttttatccccccnnntaaaaaggggggggaaaaaaaaaannnnncccccccttttctcttaaaaaaaatacccgggggggggggttnncccggcggccctttttttgggggggggaaaaaacactctttttttaaaaaaaaaattttttttccaaaaa

SEQ ID NO: 88394 - DNA, 831 bp, Zea mays
  misc_feature: Ceres CLONE 1575716
  misc_feature: Translation starting site: 168
  misc_feature (587)..(587): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
ctggagctccccgcggtggcggccgctctagaactagtggatcccccgggctgcaggaattcgtctcacccctagaaaaaatccgccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaaacacgccggcttcccgcacaacgtcgtgttcgacgaagacgaggtgccgagcggcgtcgacgcctccagatctcgcaggaagagtaccctcacgcgccaagcgagaactactccgtcaccctcaccgtgccggggcactacggcttctactgcnagccggaccaaggaagcagaaatggcccgccaaaatccaggtcaaactaaggctaggcaatcctttccagggcattccgaaattggaatgacccccccccccctccaaggggaagaaagcccccccctcccccccccggggttttcccccccccgggggcacaacaatttttggggccaacaaaataaagggcccctccttctttggggggggggaaaaaaaaaaannnaaaaaaagggggggg

SEQ ID NO: 88395 - DNA, 902 bp, Zea mays
  misc_feature: Ceres CLONE 1575718
  misc_feature: Encodes the peptide sequence at SEQ ID NO. 88396
ctggagctccccgcggtggcggccgctctagaactagtggatcccccgggctgcaggaattcgtctcacccctagaaaaagccggccgctgctctcttcctccctcctcctcggtccactccaacgtccaaccccaggcctgccgcggccacagacgggccgcgccgccgccgcagcttccgattccgcttccgccggccgttctgccccgcgcgcgcctgtggcgcttgagcgggcggatttgttcggcccgttctttggccgccgccgttgcgctgcgccgtgttggcttccaggcgtcttgagattccccggccggagatctgcttaattcgtacctctctctggttctgaggcccctccgaggtggaggaggagctcgtgggtcgacgaaagaacaatcgtttctttgcccactcctgcggctgcttctccgtcccaggctttccagccatggaggaaggtggaggtggccaacatggccgcggtggagagctgccaccgggtgctggctctgctctcgcagcagcaggacccagccctgctcaagagcgtagcttcagagacggctgaagcctgcgccaagttcaagaaggtagcggccctcctcggcagtgccagtggcggaggtggctgtggccatgctagaggcaggttctccagacgagtccggcctctggggctcgtcaaccagaagacccccttggggatcgccaccggcagcggcaacccgctggagatgatgcccagcacagctgctgctgctgggtctccatctccacctcagtcgactagctatgcgcaaatgcgcgctcggcttagcagtgcgcagagtcctcacgagggctggatttggctgctccagcagcaggtgagccctcatccatttgtagcccccagct

SEQ ID NO: 88396 - protein, 141 aa, Zea mays
  misc_feature: Ceres CLONE 1575718
MAAVESCHRVLALLSQQQDPALLKSVASETAEACAKFKKVAALLGSASGGGGCGHARGRFSRRVRPLGLVNQKTPLGIATGSGNPLEMMPSTAAAAGSPSPPQSTSYAQMRARLSSAQSPHEGWIWLLQQQVSPHPFVAPS

SEQ ID NO: 88397 - DNA, 962 bp, Zea mays
  misc_feature: Ceres CLONE 1575719
  misc_feature: Encodes the peptide sequence at SEQ ID NO. 88398
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
gacggtagcnnncgtaaggggacggaggagaggggagcgggggnnngnnnnnnnnggttnnngtccaagctgggactccccgcggtggcggccgctctagaatagtggatcccccgggctgcaggaattcgtctcacccctagaaaaaacgcgcaccaccacaaccaatcctcctccccccttcgagtccccgtcctgccccaacaatcccaatctccggaagaaggggaagcaagcatcagaaatcctaaataggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcgctgcggtatttagccaatgccgacagcgacgtgctccaaggaagcggcagcccggagcgcactgcgggatctgcggggagccgacgactccttgaactgcgcggacaaaaggggccggagaagaaaaagaacgggggtccttcttgggcccgctctttgagctactgccgaaatccgtttgctccggtgcaagaaccggggggcggcgggcaaaaggcaaaaaccggcggcctgcggggaaggaaaaatggggttgccccacggggaacttgcaaccacgtggggggccaccgccccacgttcaaaaagggttcccccgggaattccctataggcccggcccccggttgaaatttccagacccccaaaagaggccccccgccccgcgggcctcccccaatgtgccccaagaggaagaaggggtgttca

SEQ ID NO: 88398 - protein, 142 aa, Zea mays
  misc_feature: Ceres CLONE 1575719
MTEVALLRGPTNLASTASRAPASPSPSPSSSSLRYLANADSDVLQGSGSPERTAGSAGSRRLLELRGQKGPEKKKNGGPSWARSLSYCRNPFAPVQEPGGGGQKAKTGGLRGRKNGVAPRGTCNHVGGHRPTFKKGSPGNSL

SEQ ID NO: 88399 - DNA, 939 bp, Zea mays
  misc_feature: Ceres CLONE 1575720
  misc_feature: Encodes the peptide sequence at SEQ ID NO. 88400
  misc_feature (592)..(592): n is a, c, t, g, unknown, or other
ctccccgcggtggcggccgctctagaactagtggatcccccgggctgcaggaattcgtctcacccctagaaaaagtccacggcaacgaaacaagtccatctagaccgttcctcctctaatccccatcctcgctccccccaaccctcaccgccatggcgaccaccgaggactccgccgccgcgggcgaggcccgacgcctgttcgccctcctcgagtcccagcagcaggtactctctgactgccacggcgcctggtcgcgcgccctcgcacactttgcctcgcgcgaggaggacctcgcctcccgctccgctgcactcgacgaagccctagccgccgccgacgtttccacttccgagactctcgcagcgctcgaggcccgcgagtcctccattcccgcgcgcctcgctgaggcctccgccgcgctctccgccgccgtcgctgaggccgagactgaatccaccgggccaccaccccacgacatcaagggcgcgctccggtggatatgccgccgcatggacgctgctgcgctctgggcgctcatggccgcacgccgccgggacctcgcgttagtccggatgtaggccggccccgncgtccccatggccgttgacccgccccgcctggcctcgaactgggaagcgatttcttaacccctggcaacgggttccggggggaccaatggtgggggccccgcatgttgcccgcccccttgtctccatttggaggcaaggaacccccgcaaaaagagaaacatttggtgaaaagggctttttccaaaccaaaaaaggggaaaacccctttgggacacaaaggaaaaattttcctctaaaaaaaggggggggaggggcccaaactgttgggccaaacccccggggccccctaaaaaaaaggggaaaaaaatagccccggggggtgggggaaaaaaaacaaaaaaaaaaa

SEQ ID NO: 88400 - protein, 142 aa, Zea mays
  misc_feature: Ceres CLONE 1575720
MATTEDSAAAGEARRLFALLESQQQVLSDCHGAWSRALAHFASREEDLASRSAALDEALAAADVSTSETLAALEARESSIPARLAEASAALSAAVAEAETESTGPPPHDIKGALRWICRRMDAAALWALMAARRRDLALVRM

SEQ ID NO: 88401 - DNA, 807 bp, Zea mays
  misc_feature: Ceres CLONE 1575723
  misc_feature: Encodes the peptide sequence at SEQ ID NO. 88402
ctggagctcaccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcgggcggacgaccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgacgccgggatggcggccccgcccgaagcctccgccgccgtggtgcaggacctcgcggcaatcgccaccgccgcgcccgcagacgacagccgaggactcctcctgctcatcatcgtcgcgcccgccatcagctgggggctcttaaacatcctgcagccagggcgcaccagctcaacgcatgcgagtcgacggaagctagctagctagcggccgcttccgtatccgcggtgggaat

SEQ ID NO: 88402 - protein, 258 aa, Zea mays
  misc_feature: Ceres CLONE 1575723
  misc_feature (142)..(176): Pfam Name: PsbY Pfam Description: Photosystem II protein Y (PsbY)
GAHRGGGRSRTSGSPGLQEFVSPLEKTLPSPPRLACHCQQVPPPSLLCSRNASTRPAACHSCHGDHSHDGAAEARRQGRGAVGAVHQQRQRLAARPDGAGRQEGCAVRVRVVHAGGRLPRGAGVVARRCAGGRGGGRTTGGDSRGQLLLVVVAPAIGWVLYNILQPALNQLNRMRSSQAVAAGLGLGAAADAGMAAPPEASAAVVQDLAAIATAAPADDSRGLLLLIIVAPAISWGLLNILQPGRTSSTHASRRKLAS

SEQ ID NO: 88403 - DNA, 838 bp, Zea mays
  misc_feature: Ceres CLONE 1575727
  misc_feature: SWISSPROT Homolog: EC 5.1.3.2 UDP-glucose 4-epimerase
ctggagctccccgcggtggcggccgctctagaactagtggatcccccgggctgcaggaattcgtctcaccccctagaaaaaaaacccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcacggggcggggcgggctacatcggtagccacgccgtgctgcagctcctcctcgcgggcttccgcgccgtcgtcatcgacaacctcaacaactcctccgagctggccgtccgccgcgtcgccgcgctcgcgggagaccactcccgcaacctctctttcacaagattgatctccgtgacaagggagcactgggaaatgtttttgcttctacaagatttgaagctgtcattcacctcgcctgggattgaaagctggtggggtgaaagcgtacaggaagccatttactttatttatgaccaaccaccgtctttgggcccgaataaatccttcctaaaaaatttattgtctgggtcccccgggttgccaaaaaaaatgggggggtcccccccccaacccacccgcgcagttttttttgtggtccccccccccaaaaaaaactcccccccccccccgcgcccacagaaaaaaatattttc

SEQ ID NO: 88404 - DNA, 964 bp, Zea mays
  misc_feature: Ceres CLONE 1575728
  misc_feature: Encodes the peptide sequence at SEQ ID NO. 88405
  misc_feature (924)..(924): n is a, c, t, g, unknown, or other
  misc_feature (943)..(943): n is a, c, t, g, unknown, or other
ggagctccccgcggtggcggccgctctagaactagtggatcccccgggctgcaggaattcgtctcacccctagaaaaagcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggcggtcattgccctcaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatgttgagaagcacgtcgctgaggctgacatcatcttcgtctcggtgaacacccccaccaagacccgtgggcttggagctggcaaggctgccgacctcacctactgggagagcgctgctcgtatgatcgccgatgtctccaagtctgacaagatcgttgtcgagaagtccaccgtccctgtcaagaccgctgaagctattgagaagatcttgacccacaacagcaagggcatcaactaccagatcctttccaacccggagttccttgcagagggcactgctattgaggaccctgtcaagcctgacagagtgctcatcggtgggcgggagacccccgagggcaggaaagcgtccaggctctcaaggatgtgtatgctcactgggttcccgaggacagatccctcacacctacctgtggtccgctgagctctcaagcttgccngccatgcgtccctggcacnaagatctcctctgtcattgcc

SEQ ID NO: 88405 - protein, 211 aa, Zea mays
  misc_feature: Ceres CLONE 1575728
  misc_feature (2)..(196): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDPVKPDRVLIGGRETPEGRKASRLSRMCMLTGFPRTDPSHLPVVR

SEQ ID NO: 88406 - DNA, 871 bp, Zea mays
  misc_feature: Ceres CLONE 1575730
  misc_feature: Encodes the peptide sequence at SEQ ID NO. 88407
aagctggagctccccgcggtggcggccgctctagaactagtggatcccccgggctgcaggaattcgtctcacccctagaaaaagcgctgcttcgctggctttcggcaacgccctttaccacatctgaatctcacccacccacccacccccgcgtcccccacctcatggcgccggcgatggggctgaagcggcctgcggcgggagcaggggcggcagcagcgcagaccgtcacgctgtccgcgcctgccgtgcgggacgcggtgcgcaccgccgtaagggaggccgaggccacggcgaaggctaccgccccggccgccagggtcccggcgacggcggcagtgccggcggagatcgctagggatggggtgctgtgcctggaggaggtcgacgggaggcggtggagctatgtggtcgacgccgccggcgccgcggtcaaggccaagggaagggcgtccgtcggcggcgccttcaaggccgtcccgctccagtccccgatgccgcccgtcgaggaaatcatgtcctttataagatcatatgttgtgcccgaaggcttttcagatagtgtccacacccttcatatgttccatacatgacctggagagcattgaaacatttctttggtggaagcaaagggggtgtttacaaaaggaacctggctcaactccgttgggatcccccaaaacaagggctgcctcctgggtgcggggggctttcaaatgggattctcaaaggattgggcgctgaggcgtttttcaaaaaaaaagcttttttggccccccccagggggaaaaaaatttttgtttttgaaccctgaaagaacccttaccccctttttggggggggaatccctcgtgaagggaaatttgaaaag

SEQ ID NO: 88407 - protein, 142 aa, Zea mays
  misc_feature: Ceres CLONE 1575730
MAPAMGLKRPAAGAGAAAAQTVTLSAPAVRDAVRTAVREAEATAKATAPAARVPATAAVPAEIARDGVLCLEEVDGRRWSYVVDAAGAAVKAKGRASVGGAFKAVPLQSPMPPVEEIMSFIRSYVVPEGFSDSVHTLHMFHT

SEQ ID NO: 88408 - DNA, 934 bp, Zea mays
  misc_feature: Ceres CLONE 1575731
  misc_feature: Encodes the peptide sequence at SEQ ID NO. 88409
ggagctccccgcggtggcggccgctctagaactagtggatcccccgggctgcaggaattcgtctcacccctagaaaaaaaaatccccaaatcgccacatcaaatcgaatccacccaccacggaccacgcattcgccatggagtttcccaagcgagggcgagcttttctccaaggttccctgcaaaggagccccaaggcgacgatacctggagctgccacgggggccgacgagaacgcaagctctaagcatctcgtgccggtgggggccgcgtcgccgaagaggaagaaggtgctcggggagaggaacgacagcggcgtcgggggcatggagggcgccgcgtcggcaccagtgcagcagccaaagctcgcgttgagccccccgacgcccgcgagccgcggcgcggggccgtacgacccgaagacgaactacaccacgccgcggccggcgttcctgcgctacgacccctaacggcgccgcgagatcctcctccgggtgtcgcgtgcggcagaggtgatgtacgacgactgctccagcaccacatccggcagtgcggcctcggaggaggacggtggctcgtccttggcctcggacgcggcggcaggctcacttatctcgtcgccgccaaggagcgactccgaggccgagcttgatgacagcgaggaggaaagagaggtaatccccagctcgtcgaggccggtgggccaagcggctgcttctgtttctcgtctgtgtgtcctgctcgttctgctacttgtattgcgccaaaccctctgggcttcctacttattcagaagacgcacttgattttggatagaggtatgggggggctgtacgatgcctatgacctgaattagactccctgagaatgttatggccagttcatttgatggggtccagagaatgtgctgaagaaaatacaaaccaactggggcc

SEQ ID NO: 88409 - protein, 110 aa, Zea mays
  misc_feature: Ceres CLONE 1575731
MEFPKRGRAFLQGSLQRSPKATIPGAATGADENASSKHLVPVGAASPKRKKVLGERNDSGVGGMEGAASAPVQQPKLALSPPTPASRGAGPYDPKTNYTTPRPAFLRYDP

SEQ ID NO: 88410 - DNA, 756 bp, Zea mays
  misc_feature: Ceres CLONE 1575732
  misc_feature: Encodes the peptide sequence at SEQ ID NO. 88411
  misc_feature (727)..(727): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
ctggagctccccgcggtggcggccgctctagaactagtggatcccccgggctgcaggaattcgtctcacccctagaaaaagccatcgccccttcctccacctctgcgctccaccacctaataattgattccactgccaatacctgcgatgagtgccgccatgccgccggcgatggaccccgcggcggcgggggagatggcgcgggaggccgccgcgtggtgctcgctgcacggcctcgtcgtcggggaccgcgccgaccagagatcagcaacggtccctggtgttggtttggtccatgctccattctccttgctcccagcacattttccagagtccttttggaggcaggcgtgcgagctcgctcccgtttttaacgagcttgtggaccgtgttagcatggacggggaatttcttgcagaatgctttgtcaaaaaacaaggccaggttgatgaatttcacatcctagggtcctgggaaattccccgggaaaatggttgggaaataaattagggaagaagaaaatttccccctggggggtttccccccccaaaacgaaatattttttggccggggatttctcaaaaaaaacaaattttttccccttttcttttcaaaaaaaaaaaagggggtccttaacccaacccccttttttttttccggggcccccacttttattttttccccccgggggggggttccttttggggttcccccccccccccccccnannnnttttttggggggggggagggcccc

SEQ ID NO: 88411 - protein, 120 aa, Zea mays
  misc_feature: Ceres CLONE 1575732
  misc_feature: SWISSPROT Homolog: EC 6.3.2.3 Glutathione synthase
MSAAMPPAMDPAAAGEMAREAAAWCSLHGLVVGDRADQRSATVPGVGLVHAPFSLLPAHFPESFWRQACELAPVFNELVDRVSMDGEFLAECFVKKQGQVDEFHILGSWEIPRENGWEIN

SEQ ID NO: 88412 - DNA, 930 bp, Zea mays
  misc_feature: Ceres CLONE 1575734
  misc_feature: Encodes the peptide sequence at SEQ ID NO. 88413
  misc_feature (886)..(886): n is a, c, t, g, unknown, or other
  misc_feature (887)..(887): n is a, c, t, g, unknown, or other
ctggagctccccgcggtggcggccgctctagaactagtggatcccccgggctgcaggaattcgtctcacccctagaaaaagcacggcacttcccagcgatttcctcgtcctctctctctctctctctctctctctctctctctctctctcgtgcgctccctctcccactcgacggaggagaaaggggggaaagcaatcggaagcgcgagccggcgagcgagatgggcgccgggagcagccgcgcggacgcgccgtcgcggcgccgggcgcgcctcgggctcggagggtgcttcgggacccgatcctcctgctcctcttcctccccagccgccgccgccgcagcgcacgacggcgggagcttcaccttggccgggtcctcctcctccagcgctatcgaggtacaatcagggcgaccagtacgtgccctgaattttcaggcttctctagctgctaaggatctccagatttccaccgcgtcaagtccaaggctgcattcctcttcaagtaccataagccatcacctcagattcaatcacctcaattgccatgaaaacaaggaagatggcctggggactgaaaatgctgaaacaagtggccttgaaagctcatctaggaaggctgtcatggtttaggggaagtttcagtaatgaagctgttaatagtgatatgtcaggagaagggataagttttttaggatcagagctgggaaaatatcctagcacagtctccactaatgaaactggtggctcagccgctgaatctgggttggggccctcatggatggcatctgaaaagatcatgtctgaactaaaaaggagagatatctcgcaagggacctcatccacaactggcctggaaaggggaaaagacagatggttcccaggcnngtacttcacagctgtgacgactcggactggctgcgggttgagt

SEQ ID NO: 88413 - protein, 136 aa, Zea mays
  misc_feature: Ceres CLONE 1575734
MGAGSSRADAPSRRRARLGLGGCFGTRSSCSSSSPAAAAAAHDGGSFTLAGSSSSSAIEVQSGRPVRALNFQASLAAKDLQISTASSPRLHSSSSTISHHLRFNHLNCHENKEDGLGTENAETSGLESSSRKAVMV

SEQ ID NO: 88414 - DNA, 826 bp, Zea mays
  misc_feature: Ceres CLONE 1575737
  misc_feature: Encodes the peptide sequence at SEQ ID NO. 88415
aaagctggagctccccgcggtggcggccgctctagaactagtggatcccccgggctgcaggaattcgtctcacccctagaaaaaagatcctctctggacgaacagaaaggttaccagcagcaccacggcgagatctccccttggcgggccaaaaccgacggcgagcttcaccggcgttggtcggctccaatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttgggctcgcctgaccatgcaccaaccctggttcaaacttcggaggccaggggcattgaattccgccaactgaaaagcgccccgtttcccaaagaacacaatggccccagcttaagacccaaacccaaaagcaaaatggtggggggtggggcctcccccccctgaaattttcttaaaaataaaagggccgggcccgaaaaaaagggagggtggggacaaaaaggggggttatcctcaagaccccccaagggggttattcccctgggggacccccccccccccccccccggtggagaaagggggggaaagggcttttcttgccgcgggaaaagggtttcccccccggggggagaagggggttttttaatttttggggagccccccccgtctggaagaaaagttgtaaagaaaaatcgaatagtccccgcaaaaaaaaaacccccc

SEQ ID NO: 88415 - protein, 46 aa, Zea mays
  misc_feature: Ceres CLONE 1575737
MGTSSGANFHQQPPPTQGMLPPRHGPRPSGLQTSLSLASSEQVGLA

SEQ ID NO: 88416 - DNA, 954 bp, Zea mays
  misc_feature: Ceres CLONE 1575738
  misc_feature: Encodes the peptide sequence at SEQ ID NO. 88417
  misc_feature (954)..(954): n is a, c, t, g, unknown, or other
ggagctccccgcggtggcggccgctctagaactagtggatcccccgggctgcaggaattcgtctcacccctagaaaaactcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggacacagctggactgatggttaatgaccctgtattgagaacaagaaagcctctttcagttgaattgggacctggaattcttggaaacatttttgacggtatccagcggcctctaaaaaccatcgctattaagtcaggagatgtgtatattcctcgtggtgtttcagttcctgcccttgacaaagatgtattgtgggaatttcagcccacaaagctacgtgttggagatgtcatcacacgtggagatctatacgctactgtttttgagaacacattgatgcagcaccatgttgctcttccaacgggttctatgggggaaataaggttcattgcaccagctggccagtacaacctgcagggacacgtgctagaatttgaatttcagggcataaaaaggaatttaccatgcttcagaactgggctggggggtccccaaggcctgttgcatcgaaccttgctgcggatccccccttctgaaagggcaaccggtcctggatgcactatttccctccggtccggggaggacctgtgcctttcccggaacattggcctggggaaaaan

SEQ ID NO: 88417 - protein, 255 aa, Zea mays
  misc_feature: Ceres CLONE 1575738
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSATIQVYEDTAGLMVNDPVLRTRKPLSVELGPGILGNIFDGIQRPLKTIAIKSGDVYIPRGVSVPALDKDVLWEFQPTKLRVGDVITRGDLYATVFENTLMQHHVALPTGSMGEIRFIAPAGQYNLQGHVLEFEFQGIKRNLPCFRTGLGGPQGLLHRTLLRIPPSERATGPGCTISLRSGEDLCLSRNIGLGK

SEQ ID NO: 88418 - DNA, 860 bp, Zea mays
  misc_feature: Ceres CLONE 1575739
  misc_feature: Encodes the peptide sequence at SEQ ID NO. 88419
  misc_feature (784)..(784): n is a, c, t, g, unknown, or other
ctggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttcctgttccccactggcaacgctaccgagaggagcttnagacggggcgtcgccgcctgcgacatgatgggtgcgagcgcggcgacgttcctgtacgtcgagcgggcgataagcg

SEQ ID NO: 88419 - protein, 228 aa, Zea mays
  misc_feature: Ceres CLONE 1575739
  misc_feature: SWISSPROT Homolog: EC 3.2.2.22 rRNA N-glycosylase
  misc_feature (203)..(203): Xaa is any aa, unknown, or other
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVTRPAAAAGDGEDPGVAAWRARDLDEAISSLFLFPTGNATERSXRRGVAACDMMGASAATFLYVERAIS

SEQ ID NO: 88420 - DNA, 839 bp, Zea mays
  misc_feature: Ceres CLONE 1575740
  misc_feature: Encodes the peptide sequence at SEQ ID NO. 88421
  misc_feature (701)..(701): n is a, c, t, g, unknown, or other
ctggagctccccgcggtggcggccgctctagaactagtggatcccccgggctgcaggaattcgtctcacccctagaaaaacacaccccggtcggctagtcccaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgggacaacttctgttgttgttctagctggagaacttttgaaggaggctgagaagttaattaacatgaaaattcatccaatgactattattgcaggttacagaatggctctcgagtgtgccagagattctttgctaaaaaagaccatggacaacaaagaaaatacggattaattcagatctgatctcatgaatatttgctatgacctactcnttagtttcaaaaatactttcccaaaaacaagggagtaccttcgcctggaacttgccggttgaatgcttggtcttgaaggccttaaggggtagcaaccaactttgggaatcctatttcaaaattctgaaagaaaaccca

SEQ ID NO: 88421 - protein, 146 aa, Zea mays
  misc_feature: Ceres CLONE 1575740
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTMDNKENTD

SEQ ID NO: 88422 - DNA, 951 bp, Zea mays
  misc_feature: Ceres CLONE 1575741
  misc_feature (757)..(757): n is a, c, t, g, unknown, or other
tccccgcggtggcggccgctctagaactagtggatcccccgggctgcaggaattcgtctcacccctagaaaaagctctgttctgccagcagttggcacaagcagcttgggcgcaacagaacaactgcgatgcgaccaagggacaatggcccgcaccggcaccgcggcgccggccgcgggctacggggaggacggagtgtaccgctccccgcgacccggccgtgcgcatctagtctgatacggggatctccctcaacgacctcctattccgccgcgccgacgtgtgcccctccgctctcgcgctggtcgactccgccaccggccaatccctcagcttcgccgcctttcgctccgacgtcctcaccacggccgtgagacctctcctcgagcgcggacccccccccgcggcgacgtcgtcctcatcttctcccccaaatgctccctcaaccccgcctgcttcttcgccgtcacccccctcggagccgtcgctaccactgccaaccccctctacacccctcgggaggtcactaaaagggccaccgaactcgggggccaagctcgcaattacgggcctctgaactccttccccaaatcctagggcctcgagcctcccccccattcctggctcaatcggcggcgggcaaccgcaaactcagcccaggtgtcggacggactcaaagcctcccgggaggccagcgcggacgcctttcacccagtacctcccttttcccgggccccgtggcaaccggagtcaccgnccgcccgcccagagaagccaaattttatcgttccccggcctccaatactaccacccggccaaaacggggggtgagccaaggacccaatccttttacacacgacaattatctttgcgcttgggaccctaatgaactcggcaccttggccccctctgaaaggcggcccccccggcctcttttggattccgggcaat

SEQ ID NO: 88423 - DNA, 1076 bp, Zea mays
  misc_feature: Ceres CLONE 1575742
  misc_feature (1047)..(1047): n is a, c, t, g, unknown, or other
ctttgctgaagctcaccgcggtggcggccgctctagaactagtggatcccccgggctgcaggaattcgtctcacccctagaaaaaacaccccggtcggcttgccccaaggctgctgccgtcgcctgctgctaggggatcgcttgctttcctcggaccactatgccaaccacatctacaccggatctacggtccttccaagtgagctccaatcccctgtctgtagatggagagggtgctcaaggatgaccccgtctaggagaagggcgatcacgccatgatggcatcgtttgttggcggcaaggcaatctaggagctggtgaaaaccactttgcgcccaaaaggaatggacaaaatcctgcaatcgactggcagaggacggaatggttacttgttacaaatgatgggaccaccacgtttgaagtcacgtacgcattgaacaaccccggactgcataagggcacttgttgaaaatctgactagagtgcaaggatggattgatattagggggtacggagaaaaagcttacgggtgtggtaattgctaaggcgcgggaggaaactttttttgtaccggaagtggctcgtagacacagtgcggttgtggacccgtggacaaaagattcggggcccggggtgggaagattagtgcgttggcacaggggtgttatcgatgaatctgcgggattatctcccgacagctggtttgcaccgataaaaaatttcattcgttcgcacttagcaataaatttgaaaccatttgtggtgcaatacgttagggggaaaataatggaacgattataaattgttcgagaaataatggaggatcctccaagtggaaaatatttgggcattagctgaatctagtcggcgtaatgaggtgtaagaagagataaaactctttttccaccaaatggaacaaaggggggaggctaacctcctcggcctataacaaatatcgtaggttgagagactacctggggatcctcccacggaccgttgacagacgtggtattacgaacaaaacgatgggtgggagagcgcatagtngaggaagaagtgcggttgagagaaacaag

SEQ ID NO: 88424 - DNA, 835 bp, Zea mays
  misc_feature: Ceres CLONE 1575743
  misc_feature: Encodes the peptide sequence at SEQ ID NO. 88425
  misc_feature (459)..(459): n is a, c, t, g, unknown, or other
  misc_feature (467)..(467): n is a, c, t, g, unknown, or other
ggagctccccgcggtggcggccgctctagaactagtggatcccccgggctgcaggaattcgtctcacccctagaaaaagcgctgtccccgaacgctactcatggactggaggagagattgggtttgacacctacttctccatggccaggggcaacgccactgtccctgctatggagatgaccaagtggtttgacaccaactaccactttattgtcccggaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcagcatccttccagtctacaaggaggtcattgctgagttgaaggcagctggggcttcatggnatcagttngatgagcccactcttgtcctcgaccttgattctgacaaattggctgcattctctgctgcatacgcagaaactgaatctgtactttctgggattgaatgtgcttggttgaaaactacctttgctgatgtttcctgctgagtcctacaagaaccctacttctcctgaccagtgggactgccctatggttttaatcctgtcccctgaaaccaaaactcttgggctttgtcaccaagggcgggtttccccggctgagaaaacaccccctttgccggggggtttggggaaggaaaccaaaatctggggcggaaaaaaattgggaaaattttccaaaaaaccctccaagtctctttggagggtttttgtgggaa

SEQ ID NO: 88425 - protein, 154 aa, Zea mays
  misc_feature: Ceres CLONE 1575743
  misc_feature (1)..(154): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (107)..(107): Xaa is any aa, unknown, or other
  misc_feature (109)..(109): Xaa is any aa, unknown, or other
MARGNATVPAMEMTKWFDTNYHFIVPELGPNTKFSYASHKAVNEYKEAKALGVDTVPVLVGPVSYLLLSKPAKGVEKGFPLLSLLSSILPVYKEVIAELKAAGASWXQXDEPTLVLDLDSDKLAAFSAAYAETESVLSGIECAWLKTTFADVSC

SEQ ID NO: 88426 - DNA, 1064 bp, Zea mays
  misc_feature: Ceres CLONE 1575745
  misc_feature: Encodes the peptide sequence at SEQ ID NO. 88427
ctggagctccccgcggtggcggccgctctagaactagtggatcccccgggctgcaggaattcgtctcacccctaaaaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgtttcaggtcatcccagggcctggtgacaagctcatggattgcagtgaactacaaggggcgaggagaaccattttgcttgctgaggagatctccctccatgggtcctcattcaagatcgagggagatggcttgaatccctacccttgggttccaccctccaaagaaacgcaattgggggaacagtggccggggcctaatttccaacgtaacttcggcaaaaaggcagggcccactcaagggaccccccgggtggtcatttgggggggcctccaatggtggacggctttttttatcaccgatggccccccgtgtttgggtggccactggtccttaggggttttagacaaccaaggggccaccctccccccggggtagaaaaaacctggctcattcttttaaaaccgtggggggggggcgacgtttttattcagtcccccccccccccatctcaggagaggcgccccttcggagtataaagccccgcgctggacaaaaccctcccgtgtggggcggaggtactccgacaaaccttgtgttgtacccttcttcacaataagccccagggtctttattataaggcactcgc

SEQ ID NO: 88427 - protein, 217 aa, Zea mays
  misc_feature: Ceres CLONE 1575745
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFQVIPGPGDKLMDCSELQGARRTILLAEEISLHGSSFKIEGDGLNPYPWVPPSKETQLGEQWPGPNFQRNFGKKAGPTQGTPRVVIWGGLQWWTAFFITDGPPCLGGHWSLGVLDNQGATLPPG

SEQ ID NO: 88428 - DNA, 870 bp, Zea mays
  misc_feature: Ceres CLONE 1575750
ctggagctccaccgcggtggcggccgctctagaactagtggatcccccgggctgcaggaattcgtctcacccctagaaaaagagccatagcctcctcgtctcctcgagaactgtagcatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtctttcttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatcccatgtaccggcgagcccccctcggcgatatttggcaacctcgtcagcgtccgcccagccgaagggaagcctcagcttgcagagcagatcaatcgccccatcacgcggagcttcggcgctcaactcgtgaagaacgtgcaggcgaatgccccaatcaagaaggccgcaatcctacccccgaggcacgcccccaaggaggaaaaagaagggtcctgccaagcagcccgctcccggaggaagtcataagtacccaccctcccactccggaacaaaaacagggaccccttgttgaagagaaaccccttacccccctccccctcaaggaagaaaggttcttcaaacccctttttctttgggggcccctcggctccgctcaaaaggcgcgccggggggaaccccccgaataaaa

SEQ ID NO: 88429 - DNA, 795 bp, Zea mays
  misc_feature: Ceres CLONE 1575755
  misc_feature: Encodes the peptide sequence at SEQ ID NO. 88430
ctggagctccccgcggtggcggccgctctagaactagtggatcccccgggctgcaggaattcgtctcacccctagaaaaagcccccgtcgctagcctcgcggagccgtcgcactcagcggaccctcgggagtcgagcgctggatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatccgccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcatttaatgttatcggtgagccgattgatgagaaaggtgatttaacgacaaacacttccttcctatccattgtggaagcccctgctttcgtttaaccgggccccggagcagccaaaattcttgttactggaaatcaaagtcct

SEQ ID NO: 88430 - protein, 167 aa, Zea mays
  misc_feature: Ceres CLONE 1575755
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIRQVCQVIGAVVDVRYDEGLPPILTALEVLDNDIRLVLEVAQHLGENMVRTIAMDGTEGLVRGQRVLNTGSPITVPVGRATLGRII

SEQ ID NO: 88431 - DNA, 1158 bp, Zea mays
  misc_feature: Ceres CLONE 1575756
  misc_feature: Encodes the peptide sequence at SEQ ID NO. 88432
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
tttttccttcccccaaccggtacaccgtccaccacgccatctccatgcctttnnnnnntcnnnnnctcaaactggaactccccgcggtggcggccgctctagaactagtggatcccccgggctgcaggaattcgtctcacccctagaaaaagtcccgtcctcgcatcccacgccacaccctcccaatccccttcccctcgcgtctccacacctttcacacgcgacgccggagagacagagcgcgcgcgcgcgcccgaaagatgtcgacgtgcgcggcggacctggcgccgctgctgggcccggcggcggcgaacgccacggactacctgtgcgggcagttcgcggacaaggcctccgcgggggacgccacgtacctgctcctctcggcctacctcgtgtacgccatgcagctcggcttctccatgctgtgcgttagccccatccgcaccaacaacaccatgaacatcatgctgtgtggaggcgctcgacgccgccgcgggggcgctcttctactacctcttcggcttcgcacttcaccttcggcacgccctccaacggcattcatccagaagcaattacttcggggggtcaagcaccctggcccaggaaccggccttcgaactaccgacttgcttacgtcgagaaagtggggcctttcgccaggcgcccgtccgcggggccaaccacggtctgggcgtccccatcgtcccggaaccggaaaccccagttttcgttccgccctgaaccctccatctctaactgcccgtcggatggcctagaaaaccgggggctttccttgtccctaccaccccccagttgtggctgtgtctcctaacctggggtttatatgggttacccgggccggtacgcgatcttagggcccgtgtgccggccacgttacgtcaccgtattccggggccccacactgggttccgttcgcgggctccccggacagaccatcctaaactttcccccctagtcctcccagcgactacctagctcgatgtgggccgggagcggacacttcatgaacggtccttcgtggcggcctcttctatattccgggggccaccacatccaaatagtgagctgttttatcccacgaaggtggcacctctccgcgagccctcacaagagtcaatagcccggtgcgcttgg

SEQ ID NO: 88432 - protein, 172 aa, Zea mays
  misc_feature: Ceres CLONE 1575756
MSTCAADLAPLLGPAAANATDYLCGQFADKASAGDATYLLLSAYLVYAMQLGFSMLCVSPIRTNNTMNIMLCGGARRRRGGALLLPLRLRTSPSARPPTAFIQKQLLRGVKHPGPGTGLRTTDLLTSRKWGLSPGARPRGQPRSGRPHRPGTGNPSFRSALNPPSLTARRMA

SEQ ID NO: 88433 - DNA, 801 bp, Zea mays
  misc_feature: Ceres CLONE 1575758
  misc_feature: Encodes the peptide sequence at SEQ ID NO. 88434
ctggagctccccgcggtggcggccgctctagaactagtggatcccccgggctgcaggaattcgtctcacccctagaaaaactcctcccaccccaaaccaaacgaacaaaaaaaaaatccaaaaaaaacgagtctttaatcctcgccatcgaccgcaaagccccctctgccccctccttttcccctccctcccacacgcaccgccgcgtccgcccccttcgctgcccctgcccggtcggttccgatggggtacgtgctgtcggcggtggcgagggtgctggagcagcccacggcgtggggggcggcccgggagatggcgctcctcgcggggccgctctgggcggcggtcctcctcggcctcctgctcggctgggcctggcgcccgcgctgggcagctggcctcgtcgccgcccccgcccccgccgccgctgcgcagccgcccttcgccacgctcggtttctggaaggcccagctccccgcccgtctccgcgccccgctcggctccgccgccgccgtgcggcacggggaggaggaggagggaggacgaggtctccgtgcgagggtacgtaaccgtgacactgtgcgcgcgctggcagcctggccggaccaatgttcgttggcgcgccaaaggaaggagctgccttggacggaatcacggaacgggtggggctttggctgggcaggggcaggtcgctcggaggcggggaaccgaggagctggccggtggggaaaacgtgaccctgggggaaccctcctggaaggcctggttggaaggggccagggaacaggccggccccgggca

SEQ ID NO: 88434 - protein, 186 aa, Zea mays
  misc_feature: Ceres CLONE 1575758
MGYVLSAVARVLEQPTAWGAAREMALLAGPLWAAVLLGLLLGWAWRPRWAAGLVAAPAPAAAAQPPFATLGFWKAQLPARLRAPLGSAAAVRHGEEEEGGRGLRARVRNRDTVRALAAWPDQCSLARQRKELPWTESRNGWGFGWAGAGRSEAGNRGAGRWGKRDPGGTLLEGLVGRGQGTGRPRA

SEQ ID NO: 88435 - DNA, 907 bp, Zea mays
  misc_feature: Ceres CLONE 1575759
  misc_feature (907)..(907): n is a, c, t, g, unknown, or other
aaagctggagctccccgcggtggcggccgctctagaactagtggatcccccgggctgcaggaattcgtctcacccctagaaaaagatagcgcagcacaccggggaaacaggagaggatgccacaatgttagagcattttgacaagggtagaaccgtagagctcaaatagggcgtggtggtgatttgtgaatgattgcttgccatgtgtgggacaaccagatcctgtgctgcgcccaactcaacaatcccaaaatccattactgcccacctgcatcgtcctctctgtaggctgcggtgtttgcattgtccgaaactcccaatacatacatacaacatgctaggctagtcctcttctagtcgcctctacccagttacttgcatcgccccgtcaaggacgccgacggcacgcggccctcggactccccgccgcgccctctgtctccgcccgaacaaagccctctcgacgacgccttgccttccttaccgtccaacgggggggcagccgttctaggaactccgttgggtcctcccccgcctgcccttcttagggtggaggagccgaaaaacccccccgttttcccggttgaatttctttccaaatgccgggggaaagttcccctggaaaaacccaaacctgccttgtgggccgttgaaccttaaaaattaagttccccggcggggggagaaaattttttcaatttcccctttggggaaaacctctcccaagggggacaggggccctttaccctgccccaaaaatttatattgaggggaaaatgcggcctccaaatttttcccgcgaaattgtccgggtgttccggccggaggggatacccctcgtttggggaaatacccctttcccttccaggataaacctattaccccgaggtttcccctttcccgcgtn

SEQ ID NO: 88436 - DNA, 969 bp, Zea mays
  misc_feature: Ceres CLONE 1575761
  misc_feature: Encodes the peptide sequence at SEQ ID NO. 88437
  misc_feature (969)..(969): n is a, c, t, g, unknown, or other
ctggagctccccgcggtggcggccgctctagaactagtggatcccccgggctgcaggaattcgtctcacccctagaaaaagcaggccgcagcccgccaccgcctctagtctctcccccgggcactgaggtgctcgctctactcttcaccccacgggagccgaagcaaccaggctgcacagtgcggccctgtgctccaagagcacccagggcgtggaccccgcatataggcggcggcgtacatgcagcgcgcgtgtacgtggcgcgtatggcgtcgacgcgggggagacaccactctccaccgccggtgggttgcgccctccatggcaccagccgcggcaagctttccagcggcgtggttgctcctcctccccatctcgttcccttgctccacgtctccgacgacaacctactccagcgggagatcccctgtcttccaggcgcaccgacccgacgatcctgttgctcaagactgcgcatgtgccctcatatgcaatctgtgcctggcatttctctgctccaagctgcgggatcaatcccggggatgatctctgggactcaaaagcagcatgctacttcttcggctgcccttcgccaccatgcaattcgccgatgcctacgctgtgaccaagcttgaccgtttcttgatgatctcgacgatctgcagactgcatctgaagccaacaaggatcatacacgctgttgttgcacccctcatactggatgcaacacttgtcattacatagctggacgaagaatacatctggaatgatgcgagtgactcttgcggacatacttagatgacgatctttcatagtcgtcgctgtcttattgatgtacagatcatacgccacgtacctgacaggaatggcaaactgccttcgccgtcatagatgcggattcctagaaagtgtacttcttaatcgctacatgaccccagtggtggctgctcttctaaaaaaccttttttn

SEQ ID NO: 88437 - protein, 58 aa, Zea mays
  misc_feature: Ceres CLONE 1575761
MLLLRLPFATMQFADAYAVTKLDRFLMISTICRLHLKPTRIIHAVVAPLILDATLVIT

SEQ ID NO: 88438 - DNA, 790 bp, Zea mays
  misc_feature: Ceres CLONE 1575762
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (345)..(345): n is a, c, t, g, unknown, or other
  misc_feature (351)..(351): n is a, c, t, g, unknown, or other
  misc_feature (358)..(358): n is a, c, t, g, unknown, or other
  misc_feature (363)..(363): n is a, c, t, g, unknown, or other
  misc_feature (559)..(559): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (618)..(618): n is a, c, t, g, unknown, or other
  misc_feature (630)..(630): n is a, c, t, g, unknown, or other
  misc_feature (699)..(699): n is a, c, t, g, unknown, or other
  misc_feature (700)..(700): n is a, c, t, g, unknown, or other
  misc_feature (714)..(714): n is a, c, t, g, unknown, or other
  misc_feature (715)..(715): n is a, c, t, g, unknown, or other
  misc_feature (725)..(725): n is a, c, t, g, unknown, or other
  misc_feature (732)..(732): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggctcccgcgggggcggccgctctaaaactagtggatcccccgggctgcaggaattcgtctcacccctagaaaagctaccgctagccgccgcgctgctcatctggtggcggctcgcctccctccccccatccgccgccgccgggctcctcctctagctcccctccttaccccgagcctttaagctcgtgctacctgccctacctatcccnaagggnagagaanagaanagaggggaaaaaaggtttccggtcggggccgggcccggggggccccccggaaaacttcccccccttggccctcccccccgttttcctttccccttggggggaaaattttttgggttttggggttttttggggggggccaaagggggggcccccccccccccccttttttccccagaaaaaaaaaaaccccccccancggcggggggggggcccccccccccccccgggggggggggcccccccccctcnnnangnggaggggggccnccccgggggggggagacaccccccggggggggaaaacccccgccggggggggaaacccccccccccccnngggggggggggggnnaatatggaantaaatcnccccccgccgcggggggggggggccttccccccccccccggagaaaaaaaaaaaaaaa

SEQ ID NO: 88439 - DNA, 1216 bp, Zea mays
  misc_feature: Ceres CLONE 1575763
  misc_feature: Encodes the peptide sequence at SEQ ID NO. 88440
  misc_feature (38)..(38): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (827)..(827): n is a, c, t, g, unknown, or other
ggggggttttgatgcctttttaatgttgtttggtggtntcgagggtaatatntnnnnnnnnnnnnnnnnnnnnnngctggggctccccgcggtggcggccgctctataactagtggatcccccgggctgcagtgattcgtctcacccctagaaaaaccgggtcctgcctcgcctcaccaccattagagggcgcgcgccaagctcgtggtgaggttttcgagacgaaggttatcgagaaaatcctggaggccgcgggggataggccagactgctttctcgttggagtacttccctcccaagacggaggacgggatcgacaacctgttcgagcggatggaccgcatggtgacgcacggcccctccttcagtgagatcacctgtggcaccgggggatccacgtctgaccttaccctcgaaatcggcaaacgtacgcacaacatggggtgtgtagaaaccatgatgcacctgaaatgtacaaacccaccactccagaagattgaccatgcctgggcaaaccatccaatcccatgaggattcccaaatgttttcggcccatcaggaggtggatgcgtgcaacatggcgcaaagactaaatcttgcagccaagtttggaatgccggttttttgcgttgagtcactcctttggacttttggctggcacggcagtaatttacccacgcccatacgctacggggccggaattatatttgtggggggcattcgggcatagataaggccttggcgcgtgttttacccaggtagagggcgccccaatccctaccggggaatctggcggtgaatacctaataagcggctgggaaacgggngataagcgtgttggccccttgccgattgagcgcagcaaaagtccatatttatcagtggaatatgtgcgagttaccatggggcaccattgagagttagtttagaggggcacccccacgggtataaggtattggagtctgtaaccgcgccttggtagccccttctaatatggggtgtgagcaagagagagactaggggagcctgtggtttgttatcgcgcaataagctgggttttgtggacgcaggggtttgcgctgggatagtgcaagacgggcgggacgcgactaattgtgggttatgttccagttgtggcgcgcgctataggctgaactagggaagaaaaaatagagcgcgcttgagagtgaacctgcccccggggacttttaaccga

SEQ ID NO: 88440 - protein, 65 aa, Zea mays
  misc_feature: Ceres CLONE 1575763
  misc_feature: SWISSPROT Homolog: EC 1.5.1.20 Methylenetetrahydrofolate reductase (NAD(P)H)
MDRMVTHGPSFSEITCGTGGSTSDLTLEIGKRTHNMGCVETMMHLKCTNPPLQKIDHAWANHPIP

SEQ ID NO: 88441 - DNA, 1135 bp, Zea mays
  misc_feature: Ceres CLONE 1575764
ttattcttccggcgaagaggatggcgattgggcaagggagaaatccttttatctattccttaaaaactggagctcaccgcggtggcggccgctctagaatagtggatcccccgggctgcaggaattcgtctcacccctagaaaaaatgaccaaagagaggaaaaggaggggaggaagaagcggaggagagagaaaccctaatctagatgggcaatcttctctgccacccctccgcggccgccgtcgccgaggccctgctgccgtccccaggccccgctccgcctccggcgctcctcgcttggtcctccccggccccggcctcctcccccgaggcctccatctcgcccacaggctgggacgcggtctgggcgctcgaggactagcagcgccgccgcctccaccggatctgggagcggggcgtcgcgtgtaaaccctcctcaccgggccccggcgaggccacgttgccgcccgtggtcttccgcctcgaccacggcggggaggtcgacgccgatggcaactgcctatgtcccgccacgcggacggtagccgctgccaaggacgacgcgcgcgagctgaggtaccgggcagtgcgccaattcaccgaaggctacggcgccgctgaggaggaccacaagaacgccgtcctacgccgtccgtgagggcacctactactcgccggcatctaatagccggggggggggcggcccatgtccctgaaaggaaactaagggcccctcttgccccaagggccccagcgcccaccggacctcgaacctccggcccgttccagtgaaacttcgcgtcgtatctccggacttcccataggggtaccgagggcttcggaggaaccagggcctatgccccgccacgccctgaggcgcaaaaccttgcgaaaactatcacgcagcatagcctaggaaatctaacaagcggagtggtcatgtgtacatcaagtagggccgttatttggatggattaggggaccttctcttcgtattgtagggcccataatataacgacctcgctgccgatggttattgttgtctctcgtttgccgctgcgaaaacagaatatatctctgcgcgaggaccgcggctcgaaaaagacatagtgtgacccactgcgcctcccttaa

SEQ ID NO: 88442 - DNA, 955 bp, Zea mays
  misc_feature: Ceres CLONE 1575765
  misc_feature: Encodes the peptide sequence at SEQ ID NO. 88443
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (46)..(46): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
aagggggtgttaaacaaagaaaaagagaccccccctnnnctcgnanaaaaaacacccaannnnnnnnnnnnnnccaaaactgggactcaccgcggtggcggccgctctataatagtggatcccccgggctgcaggaattcgtctcacccctagaaaaatcgtttcaccgctattcctcctgccccatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccggcggcttgagcacccacacccgcgcttcctccgctatgcaagccccgttccgtcccacgccgaccacacggccatccttgcggcgccggagacccgggtcaccacgctgcccaacggcctgcgcgtggccacggagtcgtccctcgccgcgcgcacggctacggtgggagtgtggatcgatgcgggcagcaggtacgagaacgaggaaggcggccggcagtcgcgcattttgtcaagcacatgctgttcaagggcacaggggaagcgtagcgccctcgcaacctgggacaaggagattggaggacatggggtggcccaccttcaacggcttaccccgtcgcggggaagcgagacgaaccttactacgcccaaagttgcctttgacaaaggaacgtcccccccttgcggatgggaaggtccctccccggggacctcccctggcaagaaactccccaatccttcgaaaccaatgccccggcatgttggaaa

SEQ ID NO: 88443 - protein, 227 aa, Zea mays
  misc_feature: Ceres CLONE 1575765
  misc_feature: SWISSPROT Homolog: EC 3.4.24.64 Mitochondrial processing peptidase
MAFRRILSTAVRRRSAIAAAASGNAREASTAVAAAPGVLAPDATPVRAPVMPYDRIAEAVNARLRRLEHPHPRFLRYASPVPSHADHTAILAAPETRVTTLPNGLRVATESSLAARTATVGVWIDAGSRYENEEGGRQSRILSSTCCSRAQGKRSALATWDKEIGGHGVAHLQRLTPSRGSETNLTTPKVAFDKGTSPPCGWEGPSPGTSPGKKLPNPSKPMPRHVG

SEQ ID NO: 88444 - DNA, 1110 bp, Zea mays
  misc_feature: Ceres CLONE 1575766
  misc_feature: SWISSPROT Homolog: EC 3.2.1.21 Beta-glucosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (307)..(307): n is a, c, t, g, unknown, or other
  misc_feature (330)..(330): n is a, c, t, g, unknown, or other
  misc_feature (331)..(331): n is a, c, t, g, unknown, or other
  misc_feature (363)..(363): n is a, c, t, g, unknown, or other
  misc_feature (380)..(380): n is a, c, t, g, unknown, or other
  misc_feature (416)..(416): n is a, c, t, g, unknown, or other
  misc_feature (424)..(424): n is a, c, t, g, unknown, or other
  misc_feature (1060)..(1060): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnntttttttttttgcatagctggactccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccccacatgagagnttctcacgacaccacctatcttnnctcacgcaaagcagtaagcgaaggtttaaccnttagcttacgccacgantctgcagagtaggcaatcaaaatggagtccaattgntgaccccntcgaaatccctcgaaagaactgggtccccctcgaacttcatcttttgtgccgccaccttcaacggaaccaatttgaaaggggcttgggaaccaaatatggaaaagggggaaaaaccatttggggaacccctttcggccccaattttttccgggaaaagggaaattgggaccgggggccaaatgcgaaaacttttggagacggaattttttccccccttttggcccaaaaaacagaggttgtccaaaatttttccaaagaaaaaaaaaaggggccctgtggacacccccaaaagaggggggccccaaaaaacccccggggggggcccaaaaaaaaaaccgccccccaaagggaaaaacacccccccaaaaagaagggttgttttttcccccggagggggggggcgccccctttttcttccccaaaaaaaaggggcccccccccccacttttttttgtttccctaaaaaaaaaaggggcgctataaccccccccccctttgtaaaaaaattttttcccccccgggcgaggagcgccccccccccccccccccctacaaaaaaaaaaaaacacccgcgggcggcctttcttttttaaaaaaacaccccccccagagaggaggtggtggggaaagtgttnaaaaaaaacccctccccccagaagggtggtcgtcttccaaaacaaaattt

SEQ ID NO: 88445 - DNA, 894 bp, Zea mays
  misc_feature: Ceres CLONE 1575768
  misc_feature: Translation starting site: 353
  misc_feature (47)..(47): n is a, c, t, g, unknown, or other
  misc_feature (48)..(48): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (730)..(730): n is a, c, t, g, unknown, or other
gagaacgcacgggaagaagggaagcagagcgaccagataatttatanngagggtnnnnnnnnnnnnnnnnnnnnnnnnnnnnnnnaaagctgggactcaccgcggtggcggccgctctagaatagtggatcccccgggctgcaggaattcgtctcacccctagaaaaagcgttcctgtaccaatggctccccaccacctggccgtggccgtggccgtggctagccttcatcctgcaccgtgctcgttgtgtggcgccctcgcgccgctgcctacccgtggcgagcttctgggaccactaactacttccagccaaaagcgcataccacgccaacctcaactctcctcgccgccatgctgcccaataacgtgtccgcatgcccaaggctctactccacctccgtcgtctgcgccctcccgcaacacgtccggtgcatgggactctggctccggctaccccaaaccccgggagctgcacgcgccctggcttaaaacgacgccccacccaggaacgtgcccccaaagaagggctcccctagaacaaaggaacccccgcccttgcttagtaacggaccccccgggggggcccctttcaaattacatgggggaccttcccaaaaaaccccctccctggcccggaaaggaaagggaacaccccccgggggccccgggaaaaaaaaacccaagggtggcgggaaaacacaaagttttccggaaaaaaaaccaaaaaangtcgcaaaaaaaacgttttttggccccctggggaaaaccccgggggcccccccggttttttcaaaaaaggcccccccctttttcttgtaaaaaaagagcctttttttttttaagaaaagggccctaccctcggggggggggaaaaaaacacccccccccccccc

SEQ ID NO: 88446 - DNA, 967 bp, Zea mays
  misc_feature: Ceres CLONE 1575772
  misc_feature: Encodes the peptide sequence at SEQ ID NO. 88447
  misc_feature (818)..(818): n is a, c, t, g, unknown, or other
  misc_feature (846)..(846): n is a, c, t, g, unknown, or other
  misc_feature (854)..(854): n is a, c, t, g, unknown, or other
  misc_feature (856)..(856): n is a, c, t, g, unknown, or other
  misc_feature (886)..(886): n is a, c, t, g, unknown, or other
  misc_feature (943)..(943): n is a, c, t, g, unknown, or other
aagctggagctccccgcggtggcggccgctctagaactagtggatcccccgggctgcaggaattcgtctcacccctagaaaaagcagtccgcaggaccggtcactcggcacgcaggctagcagcacagcagcagccagagccatcccctctcctcgctacgcttcgcttcctcggcgccgattcctcctcctcctcctccaccctcgtccgtccccttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactttgttactgcagaggatgtccagaagagcaggatcttctatatcctatggtccccatcctccgccaaggtgaagagcaagatgctttatgcaagctcaaaccagaaattcaagagtggcctcaatggcattcaggttgaactccaggccacagatgcgagtgaaatcagcctcgatgagatcaaggatcgggtacgctaggcgcaccgccatcgcgagtttcatggtcacgcatcatggactcgcctactactgtggatttgtacgccattatagacttggtgctgcgaaagactgctttggtgatttgtgggtttggtgctgtgtaaaagatcctcatggcttcagaagacatgaanggttggatctatcatgtaaattcctggntatctgcnantatgtatggactatggacatgtggtgcgcntgtcactcactacaataagtaatcgatatattccctacaaaaaaaaaaaaaaaacangcatacacgcatactgcataccaa

SEQ ID NO: 88447 - protein, 139 aa, Zea mays
  misc_feature: Ceres CLONE 1575772
  misc_feature (12)..(139): Pfam Name: Cofilin_ADF Pfam Description: Cofilin/tropomyosin-type actin-binding protein
MANARSGVAVNDECMLKFGELQSKRLHRFITFKMDDKFKEIVVDQVGDRATSYDDFTNSLPENDCRYAIYDFDFVTAEDVQKSRIFYILWSPSSAKVKSKMLYASSNQKFKSGLNGIQVELQATDASEISLDEIKDRVR

SEQ ID NO: 88448 - DNA, 786 bp, Zea mays
  misc_feature: Ceres CLONE 1575774
  misc_feature: Encodes the peptide sequence at SEQ ID NO. 88449
  misc_feature (683)..(683): n is a, c, t, g, unknown, or other
  misc_feature (705)..(705): n is a, c, t, g, unknown, or other
  misc_feature (716)..(716): n is a, c, t, g, unknown, or other
ctggagctccccgcggtggcggccgctctagaactagtggatcccccgggctgcaggaattcgtctcacccctagaaaaatagaaaaagaaaaagcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcacccatggagagggacccccgagaaagaagaggtacccccgggcggcgcctttcgacccgctcgggctttctccaagaaccccgccnaggttcgaggaggtacagctcnaggaggatcangaaccgggcgcctcgccatgtctggcctttcgtcgggcttctggcttcaagcaattccggcgtacccccg

SEQ ID NO: 88449 - protein, 220 aa, Zea mays
  misc_feature: Ceres CLONE 1575774
  misc_feature (54)..(197): Pfam Name: Chloroa_b-bind Pfam Description: Chlorophyll A-B binding protein
  misc_feature (194)..(194): Xaa is any aa, unknown, or other
  misc_feature (197)..(197): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPVPWGTLPTILVIEFVAIAFAEHQRTHGEGPPRKKRYPRAAPFDPLGLSPRTPPRFEEVQLXEDXEPGASPCLAFRRASGFKQFRRTP

SEQ ID NO: 88450 - DNA, 1235 bp, Zea mays
  misc_feature: Ceres CLONE 1575779
  misc_feature: Encodes the peptide sequence at SEQ ID NO. 88451
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (60)..(60): n is a, c, t, g, unknown, or other
  misc_feature (61)..(61): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
aagggggttannnggccgcccgagtgggtccccacacgccgcagccgccctttggcgggnnttaaatttnnntcaaactggaactccccgcggtggcggccgctctagaactagtggatcccccgggctgcaggaattcgtctcacccctagaaaaaacgccatgcgactcgtcacggcctcggcgtgccgcctgcgtgcccggtgcccgtgcggccgtgacgaacgacactgacgagcaaagcaaagccaacggagccgagcgagacgactagaccgcgattgctagctagctagttcgggcagcgagcggggtgagacggctatggcgtgctgctccgccgtcctgcaccatccgctgggcttctcactcaccccgtgctccacctcccgagccccaccgcgcatccagcgcgtgggcgtggcaactccctcggccgcctccgcccgccctctatctcgcgccaggatctcaccccccccccccctactccagtggcgccagcgctaccccctggtcctgggggagcctaccttgcggacggcagcaccaacaaggaccttggagaatgccagggtgcgccaccagggccggcccggccttgggttacgaactacgtcttaatcagccacggccctccgtccgaagcggctcccacaattttcatgggtccctggcttttcttcggaagacaggagttttcgtccagaatgttcttggcccctactactggtcagctgggcgaatacaccccaaataatggaggtgggatgttctgtccactcacccttccgaaatacacactagagcggatagaaatgcgtaatcacactaaattctaaatgggtggggtgcgagtttcattggccattggaaggcgtagggaaaagtgtcgcagtcttttacgcgcatttctcgccgcgcggtgtagagatgtccgcaggagggggcgtgggcccgggatgttacgccgcggcgctcatgacgcgagaataaacccccggctaaggttgtacaaattggctctttaatttaatgcgagaacagagggtgagaaagagggggagacgttccatcgtgataatgaggcctctgtgggtagtacaattgcctctgtcaaaaagatagtgacgctgtgtaatacgcagatatctcggtgattttgttaaacccacgaaaagaggccattagagtggtataaagcgctaggacgtcatatgctctttcggagacca

SEQ ID NO: 88451 - protein, 99 aa, Zea mays
  misc_feature: Ceres CLONE 1575779
MACCSAVLHHPLGFSLTPCSTSRAPPRIQRVGVATPSAASARPLSRARISPPPPLLQWRQRYPLVLGEPTLRTAAPTRTLENARVRHQGRPGLGLRTTS

SEQ ID NO: 88452 - DNA, 932 bp, Zea mays
  misc_feature: Ceres CLONE 1575782
  misc_feature (113)..(113): n is a, c, t, g, unknown, or other
  misc_feature (458)..(458): n is a, c, t, g, unknown, or other
  misc_feature (459)..(459): n is a, c, t, g, unknown, or other
  misc_feature (519)..(519): n is a, c, t, g, unknown, or other
  misc_feature (833)..(833): n is a, c, t, g, unknown, or other
  misc_feature (892)..(892): n is a, c, t, g, unknown, or other
ttgggagaagggaaagaaaggaaaaaaaaagaaagggaaaaggggggagggagaaaacgtggattaaaagaagggcgagggtgggagtatttttaaaaactgggaactcaagngggtggcggccgctctaaaaatagtggaatcccccggggctgcaggaaattcgtctcacccctagaaaaatcgttgagagagtcgtcccctccgccgtgctctccgcctgcggcatctgtatcccacaacgaaaaactaccaaaaaaattagaaatccccaaatccggcgagatctatcagtatcgagcgatttaccgatccgattgctagggtttagtttcgaaaaagaaactctgaaaaaaaattctggtcgaggggaaggagaacgatgggcaagcgcaaattggcggcgggtggtgggtggcccaaaaagggaagccccccggggggcggcttgtaccccnncaggtgggtggtcccccggggaaacgggtcggccgttcggaaaacttcggcgttgggccnaaaaaaaccgtttttcccggaaaaaaaaaagattccccccctcctaaaaacatttttgggggggaaaaaaactttgtaaaaaggggggggtttcccggggtgttttatcgggggaaaaaaattccccaaaaaaaatttgttgttaaacggaaaaaaacttttttttttttttaaaagcccacaaaaaaatatagtggggggggaaaaagaagagggggggggggggatcatcggggagggggaccaccccccttttttttttttgttaaaaaggggggggaaaaaaaaaatatataaaataccttttattgaangggggccaccggccaatttattaaaggtagtatgggggaaaaaaaaaaaaaataactcnccgggaaaggagagggggaaaaaaaaaaaattttttataa

SEQ ID NO: 88453 - DNA, 850 bp, Zea mays
  misc_feature: Ceres CLONE 1575783
  misc_feature: Encodes the peptide sequence at SEQ ID NO. 88454
  misc_feature (470)..(470): n is a, c, t, g, unknown, or other
  misc_feature (481)..(481): n is a, c, t, g, unknown, or other
  misc_feature (482)..(482): n is a, c, t, g, unknown, or other
aaagctggagctccccgcggtggcggccgctctagaactagtggatcccccgggctgcaggaattcgtctcacccctagaaaaaaccatggagaggatcagtggcccgcgcctcgctgtcctgctcgctctcgccgtcctcaccgccgtcgccgcagcgaccacggacgaggtgcgcgcgcagtccacctacatcatccacctcgccccaggccacccggcgctgtccgcagcgcgcgacaacggcggcgacgaggcggccctccgccgcctcctcccgcgccgcctgcgcgcgccgaggccgcgcgtgctctactcctaccagcacgctgccacgggcatcgccgcgcggctcacgccccagcaggcggcgcacgccgcggccggggagggcgtcctggccgtgtaccccgaccaggcgcggcagctgcacaccacccacaccccggcgttcctccgcctaacggaggnccgcggggctnnctccggctgcgacggggggcgcgtcgtcgtctgccgtcgtcggcgtgctcgacaccgggctctaccccatcggccgggtcttcgttcgcgcagcggatggtctcggccgggggcccggtcccttctttggggggaggcttttccgcgggttcctttaaagggtccgccttaatggaaagaaaggttatcgggggccaaatttcttccaccagggggtaaaaaaattgtcttttgggcccccccttcctatagaaaccaagggattcaaaaaccccccctgggaaccttgggggccctggggaaccacccccgccccccaatgggggggggggttcccccggggggggggaaaccgggggtttttttaa

SEQ ID NO: 88454 - protein, 188 aa, Zea mays
  misc_feature: Ceres CLONE 1575783
  misc_feature (33)..(115): Pfam Name: Subtilisin_N Pfam Description: Subtilisin N-terminal Region
  misc_feature (128)..(128): Xaa is any aa, unknown, or other
  misc_feature (132)..(132): Xaa is any aa, unknown, or other
MERISGPRLAVLLALAVLTAVAAATTDEVRAQSTYIIHLAPGHPALSAARDNGGDEAALRRLLPRRLRAPRPRVLYSYQHAATGIAARLTPQQAAHAAAGEGVLAVYPDQARQLHTTHTPAFLRLTEXRGAXSGCDGGRVVVCRRRRARHRALPHRPGLRSRSGWSRPGARSLLWGEAFPRVPLKGPP

SEQ ID NO: 88455 - DNA, 891 bp, Zea mays
  misc_feature: Ceres CLONE 1575786
  misc_feature: Translation starting site: 286
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (505)..(505): n is a, c, t, g, unknown, or other
  misc_feature (508)..(508): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (548)..(548): n is a, c, t, g, unknown, or other
  misc_feature (549)..(549): n is a, c, t, g, unknown, or other
  misc_feature (555)..(555): n is a, c, t, g, unknown, or other
  misc_feature (557)..(557): n is a, c, t, g, unknown, or other
  misc_feature (567)..(567): n is a, c, t, g, unknown, or other
  misc_feature (577)..(577): n is a, c, t, g, unknown, or other
  misc_feature (578)..(578): n is a, c, t, g, unknown, or other
  misc_feature (597)..(597): n is a, c, t, g, unknown, or other
  misc_feature (613)..(613): n is a, c, t, g, unknown, or other
  misc_feature (617)..(617): n is a, c, t, g, unknown, or other
  misc_feature (618)..(618): n is a, c, t, g, unknown, or other
  misc_feature (620)..(620): n is a, c, t, g, unknown, or other
  misc_feature (624)..(624): n is a, c, t, g, unknown, or other
  misc_feature (626)..(626): n is a, c, t, g, unknown, or other
  misc_feature (631)..(631): n is a, c, t, g, unknown, or other
  misc_feature (650)..(650): n is a, c, t, g, unknown, or other
  misc_feature (698)..(698): n is a, c, t, g, unknown, or other
  misc_feature (700)..(700): n is a, c, t, g, unknown, or other
  misc_feature (717)..(717): n is a, c, t, g, unknown, or other
  misc_feature (721)..(721): n is a, c, t, g, unknown, or other
  misc_feature (722)..(722): n is a, c, t, g, unknown, or other
  misc_feature (725)..(725): n is a, c, t, g, unknown, or other
  misc_feature (731)..(731): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (749)..(749): n is a, c, t, g, unknown, or other
ctggagctccccgcggtggcggccgctctagaactagtggatcccccgggctgcaggaattcgtctcacccctagaaaaacctcctcctcatctcactcactcccttttcctcacgccccctccccgcctcgagcccctcgctggctcgctcccattcccatctcgcaccaccaaccttccggatccagtgccgcacgcctcactccccgtccccgacacccatgacacgcaagaggcgcaagcacgccgccgccaccgccgcctagggttccgatcccttcctcatggattcgctgccgcgtaagcgcaagggcgcgcgcgccgcgtgctccatggccggatcccgccacgatgcgcctgccgcccgcaagcgcacctgccgcgagcccaagccgcggcccgagaagaagaagccctcttccgccgatgagggctccgcctccgcccgcggcgcgggggatttaaacagggccccnnnnnnnnnnnnnnnntnnncnncntccnccncnnnntncctnnnnaccnnnnnntnccccccccnannaanntactcntnccaactcccnaaaaaccctnntcaatccaacttctcaaanttcccacaaaggaacntccnnancaancnaaccntctggccaccaggccatcnattctttcccttccaattctttcaaaacccccgccccctttcaaaaantngggacgaatcccacatntaannttnaatccncccaacccactacnnncnaaaactcccccttgggaaggggggggggcggcgggcatcctgacgcccgaaaaaaagacagggagaaaaccctgggcttcccgggcatcggggaaggggattcccccctgcccgggcgaaccaatgggttcgtagggtacat

SEQ ID NO: 88456 - DNA, 949 bp, Zea mays
  misc_feature: Ceres CLONE 1575787
  misc_feature: Encodes the peptide sequence at SEQ ID NO. 88457
  misc_feature (809)..(809): n is a, c, t, g, unknown, or other
  misc_feature (846)..(846): n is a, c, t, g, unknown, or other
  misc_feature (929)..(929): n is a, c, t, g, unknown, or other
  misc_feature (949)..(949): n is a, c, t, g, unknown, or other
ggagctccccgcggtggcggccgctctagaatagtggatcccccgggctgcaggaattcgtctcacccctagaaaaaatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccctaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccggccggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcgggggcggggcactggcggatgctggtgggcagcgtgcgcggcgcgcgcgggaatgcgctggtgtaccngagcggggactcaggacgtggacgaaagccagcaccngctgcactcggcgcgctaccgggggaatgtggaatgccccaacttcttcccggtgttcgggcccggggctgcaggccgcctcnaaacctcggcgcccggaaan

SEQ ID NO: 88457 - protein, 273 aa, Zea mays
  misc_feature: Ceres CLONE 1575787
  misc_feature (58)..(265): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (227)..(227): Xaa is any aa, unknown, or other
  misc_feature (267)..(267): Xaa is any aa, unknown, or other
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRPDINYQVQVLALPKDASDPLLREWEKPEEYNPVATPAAGGINATQFRDPTTAWRHAGAGHWRMLVGSVRGARGNALVYXSGDSGRGRKPAPAALGALPGECGMPQLLPGVRARGCRPPXNLGARK

SEQ ID NO: 88458 - DNA, 728 bp, Zea mays
  misc_feature: Ceres CLONE 1575789
  misc_feature: Encodes the peptide sequence at SEQ ID NO. 88459
ctggagctccccgcggtggcggccgctctagaactagtggatcccccgggctgcaggaattcgtctcacccctagaaaaagtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccggggactcagctttttccctctcaacaaagcaacaaggggccccccctggtgtttcttttggaagatggtacaaggggtttttgatatccccctagaagaaaatgttttcaaaaagggggaaaaaaaaaaaaaattttgtttagaaaacccggtttaaaatctaagtttttttttttataaccgggcaaattttttttcggaacccttttttttggggggggggggggggagaacaaaacccttccccccggggggggggaatcttc

SEQ ID NO: 88459 - protein, 126 aa, Zea mays
  misc_feature: Ceres CLONE 1575789
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGDSAFSLSTKQQGAPPGVSFGRWYKGFLISP

SEQ ID NO: 88460 - DNA, 907 bp, Zea mays
  misc_feature: Ceres CLONE 1575791
  misc_feature: Encodes the peptide sequence at SEQ ID NO. 88461
  misc_feature (637)..(637): n is a, c, t, g, unknown, or other
  misc_feature (638)..(638): n is a, c, t, g, unknown, or other
aaagctggagctccccgcggtggcggccgctctagaactagtggatcccccgggctgcaggaattcgtctcacccctagaaaaaatccccgcttgattagcggcagccactctctccctctccactcttggtgtccgagtcccttggccgtacgctctgcctcactccgtctcttgcttctcctgccgccggcgtcggagagcgagcttctcggcgggcggcggcggcgcgcggcgctgggtgcggatcggccgcgggtgcatggtggaagccgccgccgggcgccggtcaggcaccagccgtcggcggcctagcggcagcggaggggagcaccagcgcctggttgcgctcgccgtcgccgcgcgcttcgccatggtcagcacccggtctgcgggtcccagcaccccccggagggagatgggagcggggagctgctggaaacagggcgccgggcccccgccttgccgggtaagcgggaacaattccatggggaggaacttttttttcgaactggcccttccccttcggctttggtttcgggggcccgtttagggcaattaaaactggggggctataggggggggggggccccccaggggggaagccgcgcgttcccccccccctttttccctttctnnggggggtgttttggggggggggggggccctttaataaaaaaaaaccaaaaaacccccgcgggggggtttatttcgtaaaaaggggggcccttctgggggggccccccccccccccccgggcggggtatatttctttggggaaaagatggggggccctcttttaggccccaccccactgtgtggcttttttgtttattgtttaagaaaagggctttttttctctcgcggcgaacaaaaaaaaggaggggctcgccccaccaaaggagtag

SEQ ID NO: 88461 - protein, 96 aa, Zea mays
  misc_feature: Ceres CLONE 1575791
MVEAAAGRRSGTSRRRPSGSGGEHQRLVALAVAARFAMVSTRSAGPSTPRREMGAGSCWKQGAGPPPCRVSGNNSMGRNFFFELALPLRLWFRGPV

SEQ ID NO: 88462 - DNA, 977 bp, Zea mays
  misc_feature: Ceres CLONE 1575800
  misc_feature: Translation starting site: 138
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (239)..(239): n is a, c, t, g, unknown, or other
  misc_feature (240)..(240): n is a, c, t, g, unknown, or other
  misc_feature (242)..(242): n is a, c, t, g, unknown, or other
  misc_feature (243)..(243): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (251)..(251): n is a, c, t, g, unknown, or other
  misc_feature (255)..(255): n is a, c, t, g, unknown, or other
  misc_feature (257)..(257): n is a, c, t, g, unknown, or other
  misc_feature (263)..(263): n is a, c, t, g, unknown, or other
  misc_feature (268)..(268): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (276)..(276): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (287)..(287): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (371)..(371): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (469)..(469): n is a, c, t, g, unknown, or other
  misc_feature (470)..(470): n is a, c, t, g, unknown, or other
  misc_feature (474)..(474): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (485)..(485): n is a, c, t, g, unknown, or other
  misc_feature (486)..(486): n is a, c, t, g, unknown, or other
  misc_feature (492)..(492): n is a, c, t, g, unknown, or other
  misc_feature (495)..(495): n is a, c, t, g, unknown, or other
  misc_feature (496)..(496): n is a, c, t, g, unknown, or other
  misc_feature (502)..(502): n is a, c, t, g, unknown, or other
  misc_feature (503)..(503): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (517)..(517): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (534)..(534): n is a, c, t, g, unknown, or other
  misc_feature (535)..(535): n is a, c, t, g, unknown, or other
  misc_feature (543)..(543): n is a, c, t, g, unknown, or other
  misc_feature (546)..(546): n is a, c, t, g, unknown, or other
  misc_feature (549)..(549): n is a, c, t, g, unknown, or other
  misc_feature (552)..(552): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (580)..(580): n is a, c, t, g, unknown, or other
  misc_feature (583)..(583): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (595)..(595): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (619)..(619): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (650)..(650): n is a, c, t, g, unknown, or other
  misc_feature (654)..(654): n is a, c, t, g, unknown, or other
  misc_feature (655)..(655): n is a, c, t, g, unknown, or other
  misc_feature (658)..(658): n is a, c, t, g, unknown, or other
  misc_feature (666)..(666): n is a, c, t, g, unknown, or other
  misc_feature (667)..(667): n is a, c, t, g, unknown, or other
  misc_feature (675)..(675): n is a, c, t, g, unknown, or other
  misc_feature (676)..(676): n is a, c, t, g, unknown, or other
  misc_feature (678)..(678): n is a, c, t, g, unknown, or other
  misc_feature (688)..(688): n is a, c, t, g, unknown, or other
  misc_feature (689)..(689): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (705)..(705): n is a, c, t, g, unknown, or other
  misc_feature (707)..(707): n is a, c, t, g, unknown, or other
  misc_feature (708)..(708): n is a, c, t, g, unknown, or other
  misc_feature (723)..(723): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (753)..(753): n is a, c, t, g, unknown, or other
  misc_feature (754)..(754): n is a, c, t, g, unknown, or other
  misc_feature (760)..(760): n is a, c, t, g, unknown, or other
  misc_feature (761)..(761): n is a, c, t, g, unknown, or other
  misc_feature (773)..(773): n is a, c, t, g, unknown, or other
  misc_feature (774)..(774): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (787)..(787): n is a, c, t, g, unknown, or other
  misc_feature (788)..(788): n is a, c, t, g, unknown, or other
  misc_feature (795)..(795): n is a, c, t, g, unknown, or other
  misc_feature (809)..(809): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (834)..(834): n is a, c, t, g, unknown, or other
  misc_feature (841)..(841): n is a, c, t, g, unknown, or other
  misc_feature (844)..(844): n is a, c, t, g, unknown, or other
  misc_feature (846)..(846): n is a, c, t, g, unknown, or other
  misc_feature (857)..(857): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (872)..(872): n is a, c, t, g, unknown, or other
  misc_feature (879)..(879): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (888)..(888): n is a, c, t, g, unknown, or other
  misc_feature (889)..(889): n is a, c, t, g, unknown, or other
  misc_feature (892)..(892): n is a, c, t, g, unknown, or other
  misc_feature (893)..(893): n is a, c, t, g, unknown, or other
  misc_feature (899)..(899): n is a, c, t, g, unknown, or other
  misc_feature (900)..(900): n is a, c, t, g, unknown, or other
  misc_feature (902)..(902): n is a, c, t, g, unknown, or other
  misc_feature (909)..(909): n is a, c, t, g, unknown, or other
  misc_feature (921)..(921): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (932)..(932): n is a, c, t, g, unknown, or other
  misc_feature (939)..(939): n is a, c, t, g, unknown, or other
  misc_feature (941)..(941): n is a, c, t, g, unknown, or other
  misc_feature (944)..(944): n is a, c, t, g, unknown, or other
  misc_feature (945)..(945): n is a, c, t, g, unknown, or other
  misc_feature (954)..(954): n is a, c, t, g, unknown, or other
  misc_feature (955)..(955): n is a, c, t, g, unknown, or other
  misc_feature (973)..(973): n is a, c, t, g, unknown, or other
ctggagctccccgcggtggcggccgctctagaactagtggatcccccgggctgcaggaattcgtctcacccctagaaaaagtcaagcttttccaaggaacctagctagctagctagtaagaggcacaggccggcaccatgtcgcaccaccattcccaccacaaatctcattctcacaaccgtacccaccaccactctcactctcactccggagagaagtgggaggaggcnnnnnnnngnngnngnngnngnggangnggaggnggagnggnnnaangnnnnngnganngnnnnnnnnnngannnnnnnnngnnnnggnnnnngnnnnnnnngnnnnngnngngnnnnnnnnnnnnnnnnnnnnnnnnnggnggggggggggnnnngnngggggngnnnnnnnnnnnnnnnnnnnnnngnnnnggggnnnngnngnngngngnnngggnnnggnngnngnnnnggggggnngggngggnnnngggnngggggnggnngggggnngggggggnnnnggnggngnnnnngggggggnngggggggnggnggnggngggggngnnngggggggggggggggggnggngggggnnngggnggggggnnnnnngggggggggggngggggggnnnnnnnggnnngggggggggggngggnnggngggggggnngggggggnngngggggggggnngggggggggnnnnngngnnggggggggggggggnggggggggnnnngggggggggggggggggnngggggnngggggggggggnngnnnnnnnnnngnnggggggngggggggggggggngggggggnnnngnnnnnnnnnnggnggggggnggngnggggggggggnggggnnnnnnnnngnggggggngnnnggggnnggnngggggnngnggggggngggggggggggngnnnngggggnggggggngnggnnggggggggnngggggggggggggggggngggt

SEQ ID NO: 88463 - DNA, 797 bp, Zea mays
  misc_feature: Ceres CLONE 1575801
ggagctccccgcggtggcggccgctctagaactagtggatcccccgggctgcaggaattcgtctcacccctagaaaaagagagagaggaagaaaaaaaaaaaaagcagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcccccctccccgcgacgacccaccacccacccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgcccccgctccaagaggaggcaccgggcgcgggcgcctggcgctggccccgaccccggggagcccgagaagccgggatctgggaggacctgctcctcaagcttcacccccttggccggaggaac

SEQ ID NO: 88464 - DNA, 992 bp, Zea mays
  misc_feature: Ceres CLONE 1575802
  misc_feature: Encodes the peptide sequence at SEQ ID NO. 88465
  misc_feature (433)..(433): n is a, c, t, g, unknown, or other
  misc_feature (478)..(478): n is a, c, t, g, unknown, or other
  misc_feature (487)..(487): n is a, c, t, g, unknown, or other
  misc_feature (488)..(488): n is a, c, t, g, unknown, or other
aaagctggagctccccgcggtggcggccgctctagaatagtggatcccccgggctgcaggaattcgtctcacccctagaaaaaaaaaccacaaccacacccgccctcccgctcgccgcagccagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaacgcccgccgctcgccgactcctccatactcntcccctacatcgccgcgccggacgacatcgcgcgagccttcggcngccccggcnntcgagctcccgccgctccccaggggcgaccccagccctggcctatggtgcacgggcaccgaacaagcgcttggcgggaagtccgcgaacttggccgcaactggccggggtaatttcgggtcccaccgaacccgcggaaacgggcccttgttcgaaacccccgtttccccaaaacggtccccttttgaaccgtccaaaggcaaagaaccccgggggccaggttcatcaaaaagggcgggaaaagaggtcttccaggggggaaaaagcccctcccgaggggcctaaaaaaagggaggggggtccccatataaaacccctcgggtggtgggataaaaaaggggcccaccccaataggggggctaagagggcgggccccccgcggaaaaaaagcccccggaggggaccaaaattcttccggcggttaacaaaaagggcccacacggaacctcttttttttttttccagagggggttgtttcaaaaaaataccgggggggcgccctttt

SEQ ID NO: 88465 - protein, 115 aa, Zea mays
  misc_feature: Ceres CLONE 1575802
  misc_feature (61)..(61): Xaa is any aa, unknown, or other
  misc_feature (76)..(76): Xaa is any aa, unknown, or other
  misc_feature (79)..(79): Xaa is any aa, unknown, or other
MLLPVCSAAPSCSPLCPVTASHVVARVARRVDVGAALRSYADSLVAQVPERPPLADSSILXPYIAAPDDIARAFGXPGXRAPAAPQGRPQPWPMVHGHRTSAWREVRELGRNWPG

SEQ ID NO: 88466 - DNA, 898 bp, Zea mays
  misc_feature: Ceres CLONE 1575807
  misc_feature: Encodes the peptide sequence at SEQ ID NO. 88467
  misc_feature (349)..(349): n is a, c, t, g, unknown, or other
  misc_feature (358)..(358): n is a, c, t, g, unknown, or other
  misc_feature (361)..(361): n is a, c, t, g, unknown, or other
  misc_feature (364)..(364): n is a, c, t, g, unknown, or other
tggagctccccgcggtggcggccgctctagaactagtggatcccccgggctgcaggaattcgtctcacccctagaaaaaggtcttccactcctcccttcttcgcctcccaatttccaaacctctctcttgggactgggagcacgtacacgcggaggaaaagcgatcggcgccgcggcggcaagatgactgcggcggcgacgatgacgtggcacgaggacctggccactctcgtgggggacacggacgttcacctcaccggcgccggggggcacgcgccggcgccggcggatgttacgccggcgggggccgggtggtacggggaggaggaagaggtgagggcggaagaangggtgggcncancangcgaaggggttcgcggagtcgacggcggagatgctgcgggagctgggccgtgggctgtgggacgtcgccgcgcagagcctcgccggcgccgaggacagcgagctcgggcggcggctgcggaagcgggcggcggccacgggggagcgcctcagcttcatgaacgagtaccttcccgaggagcgcgacccagtgaggtgttggctcatcgtcgccgcagtctcattcgtcacgctcctagttttaggtgctgggaatggcaatgaaactccagtagagcttccaaagaaacttaccatctgtccccccagtgctgatagaatccaacttcctgatggacgacatctggcttatgaagaccaaggagtctcagctaacagagcaagatttcactgattgccccccattctttctttctcaagggtaaaaaggaatcccgggaattagggctcccctccaaaaaattgggagaccacttgtgacccatgaactcccgggtttggggaaaaggaccacccatgggccggatctcatttt

SEQ ID NO: 88467 - protein, 120 aa, Zea mays
  misc_feature: Ceres CLONE 1575807
MLRELGRGLWDVAAQSLAGAEDSELGRRLRKRAAATGERLSFMNEYLPEERDPVRCWLIVAAVSFVTLLVLGAGNGNETPVELPKKLTICPPSADRIQLPDGRHLAYEDQGVSANRARFH

SEQ ID NO: 88468 - DNA, 1229 bp, Zea mays
  misc_feature: Ceres CLONE 1575808
  misc_feature: Encodes the peptide sequence at SEQ ID NO. 88469
  misc_feature (15)..(15): n is a, c, t, g, unknown, or other
  misc_feature (763)..(763): n is a, c, t, g, unknown, or other
gggaggggaagattntaaaaggttcttaaagaataaataaactgatactggggcgaaggcaaatattattgggtggggtttgaaaaactgtactccccgcggtggcggccgctctagaactagtggatcccccgggctgctggaattcgtctcacccctagaaaaaaaaatcagctacccaccaccgtccgtcagcggcggcggcgagagcatggcggccatcgtggcggcgcgggcgtcggcccctggcagggcggccgtcagcaccatcgccgcgttccacagccacgcgtccccttcccgcgcgctcccgctcgcctcgtcctccatcggcggcgccaggctgtaccaccacgcccccgcgtgctgcttcgccaccaagcccaccgcgccggccgctgccgagctcgtcgaccaggacctcgccacggccacgcaggaggccgccaagccacgccgggaaacgccggtctcggaaggcgaagaagtccgccaccgccgcccaaggaagtaggatggggacgggacgacaagcccggtgggcggccgggcataggtacgtaggccgaaaaatggaaagaatggaagggcgggcccgggcgtccctaatgtaacaatgccgcccccggggcattttggttggggccggggtccctccaaacaaaaccgatggaatccgctttcaaacccttcccgctggggggattcctgtggggatccgagggccggggataccacccgcggcccaggcgggtctggtttntacccaaaaactcaaaagacgcatctggtcgtggcatcaggctcagtataggtttgtttccttttcgcgtacgtgtgggaggcattgtgtgggtggccccaaaggagaatattttttttcgagagaggtcgcggaacccctgtttagggacgcacataaaccttgttctcgacctttctgtggtcctgttatatatgataaatgtcataaacaaaggagggcgctctcgttggtccctccttctctctccgccgtttaggtacaaaagggaaacccccatatagtaggtggcggcgagaaagtctctcgcagctgtgttatgagccaccagagaggtgggcgcggccctaaggagataaatcacccatatgccgatgtacggccccaaggatgcccccgagggggaagtaggtacactaacgatatattctggtgtataaattcgtggtgcgagagagcaaatcag

SEQ ID NO: 88469 - protein, 100 aa, Zea mays
  misc_feature: Ceres CLONE 1575808
MAAIVAARASAPGRAAVSTIAAFHSHASPSRALPLASSSIGGARLYHHAPACCFATKPTAPAAAELVDQDLATATQEAAKPRRETPVSEGEEVRHRRPRK

SEQ ID NO: 88470 - DNA, 811 bp, Zea mays
  misc_feature: Ceres CLONE 1575811
  misc_feature: Encodes the peptide sequence at SEQ ID NO. 88471
  misc_feature (654)..(654): n is a, c, t, g, unknown, or other
  misc_feature (664)..(664): n is a, c, t, g, unknown, or other
ctccccgcggtggcggccgctctagaactagtggatcccccgggctgcaggaattcgtctcacccctagaaaaaacctctaaacttcttttcctatttaaccgttttatgtgcccccttcttcccgttacgattaccatcgtcaccgccaatgccgccgcctccaccaacgggcgaaccgaagcgccgccggctgctatccctcatggcagtctacccatgcgagagcatcgcgccggcgcctctgttcagctcgcttctcgcacttgcggccgacttggcgagccaagggctcggcgccgacgccggcgccttccctgttctccggcgcggcttacggcaggcagtgcggattgcaggcctcctcctcgcgtttctggaggaggtccaagacgtgtcagtgacgaagacggcacctctgccatcatcggcggtgctggggctcacggagctgcacgtggccatgcagaagctgcggttactcctcacggactgcgcgcgacggggcgcgcggctgtgggtgctcgtgaacgccggattggccgcgtctgagctccgagtgattctcgggtccgtcgctgcggccatggacgcgctgccgaaggacgttgtggacgcgtccgtggaggccggggagctcgcgcggctcatgtcngatcatgccntggccgggtggcggtgcttccggaccccagcgactagcgccgggcgaggaacgtgcggtcgatactggagcagttcaagagcggcgtctcgccggaccccgagaaacccagggcggtgctagagcacatccggggttagaaagctga

SEQ ID NO: 88471 - protein, 211 aa, Zea mays
  misc_feature: Ceres CLONE 1575811
  misc_feature (172)..(172): Xaa is any aa, unknown, or other
MPPPPPTGEPKRRRLLSLMAVYPCESIAPAPLFSSLLALAADLASQGLGADAGAFPVLRRGLRQAVRIAGLLLAFLEEVQDVSVTKTAPLPSSAVLGLTELHVAMQKLRLLLTDCARRGARLWVLVNAGLAASELRVILGSVAAAMDALPKDVVDASVEAGELARLMSDHAXAGWRCFRTPATSAGRGTCGRYWSSSRAASRRTPRNPGRC

SEQ ID NO: 88472 - DNA, 970 bp, Zea mays
  misc_feature: Ceres CLONE 1575816
  misc_feature: Encodes the peptide sequence at SEQ ID NO. 88473
  misc_feature (640)..(640): n is a, c, t, g, unknown, or other
  misc_feature (643)..(643): n is a, c, t, g, unknown, or other
  misc_feature (708)..(708): n is a, c, t, g, unknown, or other
  misc_feature (709)..(709): n is a, c, t, g, unknown, or other
ctggagctccccgcggtggcggccgctctagaactagtggatcccccgggctgcaggaattcgtctcacccctagaaaaagcccaaaccgcaccaacggccaacgcacaaaaaaccattctcagcctcctctcctactcgagcagctagcccagtcaatcattctgcttggattggatccaccttgtctctgaaaatagcttcgagaccttagcgcccaagaaacggtgaccgaccgtccctgcgctagtagcaacagcaacaatggcggcggagcgcctacacgacgggtacgagcaggacggcgaccagcccggcgacaaccgcatgcgccgcctgccgtccttgtcgacggtgattcgggaggcgatgatgcagaaggagatgcagaacctgctcaggtgtctggagcctctcatccgccgagtggtgcaagaggaggtcgaggcagggctcaggctcatgcagagcctgcgctacatcgagagggcgccggcggagacgccggctgcggagcgggcggcgtggaagctggcgttccggacgccgccgcagctgccgatcttcacgggcagcaaaatcgagggcgaggccgggaggccgctggaggtggtccctcgtggaacgcagcaagggttcgnccntgcgggccccccggtcccgggggcgctgcccgtggagctgatccccgttgttccgcgacctcccnnccggacgggcgccagggactggcccccgaacaaattggaaaggaacctccctgaaggaaccccaagggaaggccccccttcctgaacggggaaattgggcctcaccttaagggaaggggcccccccgggggggggagcccccgttacaagaaaaatccccctggggtccccaaccagtgtttccaattcccccccccttggggcccgggaaatgggggccccggggtcaaaagagcccataaaaaaccctttgggttggag

SEQ ID NO: 88473 - protein, 176 aa, Zea mays
  misc_feature: Ceres CLONE 1575816
  misc_feature (126)..(126): Xaa is any aa, unknown, or other
  misc_feature (127)..(127): Xaa is any aa, unknown, or other
  misc_feature (149)..(149): Xaa is any aa, unknown, or other
MAAERLHDGYEQDGDQPGDNRMRRLPSLSTVIREAMMQKEMQNLLRCLEPLIRRVVQEEVEAGLRLMQSLRYIERAPAETPAAERAAWKLAFRTPPQLPIFTGSKIEGEAGRPLEVVPRGTQQGFXXAGPPVPGALPVELIPVVPRPPXRTGARDWPPNKLERNLPEGTPREGPPS

SEQ ID NO: 88474 - DNA, 975 bp, Zea mays
  misc_feature: Ceres CLONE 1575818
  misc_feature: Encodes the peptide sequence at SEQ ID NO. 88475
  misc_feature (975)..(975): n is a, c, t, g, unknown, or other
gagctccccgcggtggcggccgctctagaactagtggatcccccgggctgcaggaattcgtctcacccctagaaaaaatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgcttccggaggccctggggaaggcgctggtggactactacccgttcgcggggcggttcctggtggtggacaccgagggcggcggggagacccgggtggggtgcacctggcgagggcgcctgggttcgtggaaggccaacccccctttgctccgctcgaggagggcccccccaccttcgaacaaccccatgggtttatcccccaagggagaaccttgggtttcgggaggcccctcgtcgggggacgtcaacccccgctggggaaattgaccgtctctctggaatgccggggggaaccggaatttttctcctgggggggggggctacctagggggggggggggcgtattttcccgggcacgcacagaatcgcagcaacgggtctcgtgggggccgggggcggatatccactaaaacgctgctggggtgggtccccccgggcgaggggcgtccgatcgccatccacacaccaagaagaagatgtggtggggtggcggtggtggatatcccgagcccgccccgccagtgtgggggcgcctgccccgcccgctgtgtgtggattgtgcaggagcatcggcgctataacatggtggtcggagtcttttgcn

SEQ ID NO: 88475 - protein, 159 aa, Zea mays
  misc_feature: Ceres CLONE 1575818
  misc_feature: SWISSPROT Homolog: EC 2.3.1.167 10-deacetylbaccatin III 10-O-acetyltransferase
MGTIVDADVGFAVKRTSRSLVPPASATPRETLRLSVIDRVAGLRHLVRSLHVFAAGGDKKRQQATATPAKALPEALGKALVDYYPFAGRFLVVDTEGGGETRVGCTWRGRLGSWKANPPLLRSRRAPPPSNNPMGLSPKGEPWVSGGPSSGDVNPRWGN

SEQ ID NO: 88476 - DNA, 901 bp, Zea mays
  misc_feature: Ceres CLONE 1575824
  misc_feature: Encodes the peptide sequence at SEQ ID NO. 88477
aaagctggagctccccgcggtggcggccgctctagaactagtggatcccccgggctgcaggaattcgtctcacccctagaaaaaattttttcgtcgcaatcctcaaaaagggaagacatggcggcgagcgcactgctgacggggtcgccgtggctgcgcatgcgcctcctaccggacgcgcccgcgcgccccttccgccacctccacctccgccggagcttctccgtccgcgcctccggcgccgacggcagccccgcccccgtccgcgtccgcttcgcgccgtcgcccaccggcaacctccacgtcggcggcgcccgcaccgcgctcttcaactacctcttcgcgcgctccaaggggggccgcttcgtgctccgcgtcgaggacaccgacctcgagcgctccaccacgaagtccgaggaggccgtcctcgccgacctcgcctggctcggtctagactgggacgaaggtcccgatgtcggtgggggatttgggccttatcgccagtcagagcggaactcactgtacaaacagtatgctgagaactttttggactctggtggcggtttaccgctgccttttgctccagccaggacctcgagcaaatggaaggaagtcgcaaaggcaaagacaacttccctcctgtgtattatgggggaaatgggggaaggggctttcaaatgcggaagttccaacagggggtttagagaaaaggggaaaccctttacacttttccggctttcccgggttggccaaaaggaagggggcccttttgagaaaattgaggggaccttaaattcccgtggggggagggggccattttgggaaacattaagaaaaccccgtgtgggggggaaattttcgcggggattttgtgagaaaaacacattggggacaaacccct

SEQ ID NO: 88477 - protein, 261 aa, Zea mays
  misc_feature: Ceres CLONE 1575824
  misc_feature (48)..(254): Pfam Name: tRNA-synt_1c Pfam Description: tRNA synthetases class I (E and Q), catalytic domain
  misc_feature: SWISSPROT Homolog: EC 6.1.1.17 Glutamate--tRNA ligase
MAASALLTGSPWLRMRLLPDAPARPFRHLHLRRSFSVRASGADGSPAPVRVRFAPSPTGNLHVGGARTALFNYLFARSKGGRFVLRVEDTDLERSTTKSEEAVLADLAWLGLDWDEGPDVGGGFGPYRQSERNSLYKQYAENFLDSGGGLPLPFAPARTSSKWKEVAKAKTTSLLCIMGEMGEGAFKCGSSNRGFREKGKPFTLFRLSRVGQKEGGPFEKIEGTLNSRGGRGPFWETLRKPRVGGKFSRGFCEKNTLGTNP

SEQ ID NO: 88478 - DNA, 858 bp, Zea mays
  misc_feature: Ceres CLONE 1575826
  misc_feature: Encodes the peptide sequence at SEQ ID NO. 88479
  misc_feature (780)..(780): n is a, c, t, g, unknown, or other
aagctggagctcaccgcggtggcggccgctctagaactagtggatcccccgggctgcaggaattcgtctcacccctagaaaaagcgtgtcttcccccacccgcgaatcacgcccgcgcgcgtcgcgcctcgccgccgggcatcccgcccgcctccgcaggtacaccattggccccgcctccgcaaatctcgcctgcgacaacctctgcctcgcgcccggtctcggcgccgcccaacgctgagatcgccaccgtccccctatacctcgcccccagcaccgagcgctgagtgccgagatcgccgcccccctatgcctctgtcgcctccacctttgaccccatattctcctccacctctaccacatccaccactccacgcgcgctaccggctttcaccctctccaagaccttttcctccttcgttgacccgcccctcctgcggcggcaccgtctcctccccgtgctctgcctcctcgccctcctccgtgtcgtcgagatctgcgtgtgtggcggcctccgagtacgccctcgtcgccatctccgacccgaagactgaagccaagcatgccgccacctcgctcgtccccggatccgccgcgtcgatcccgactagcgccgccattccgtgtgccatcgttttcgccaaggcattccggggccattttgtgccgctgcgctcggacaagaacatcgtcaagagcttggtcatgcaatgggacaagttcgtggcgcagccccgtgctgcgctcgagctgaacacgaggtcggcggccagggtgtcntgtgggagagcgaggaccagggagatgatgcagggcagcacgacaatgcaaagtgttgatcttgtgtacgtgaggtct

SEQ ID NO: 88479 - protein, 183 aa, Zea mays
  misc_feature: Ceres CLONE 1575826
MPLSPPPLTPYSPPPLPHPPLHARYRLSPSPRPFPPSLTRPSCGGTVSSPCSASSPSSVSSRSACVAASEYALVAISDPKTEAKHAATSLVPGSAASIPTSAAIPCAIVFAKAFRGHFVPLRSDKNIVKSLVMQWDKFVAQPRAALELNTRSAARVSCGRARTREMMQGSTTMQSVDLVYVRS

SEQ ID NO: 88480 - DNA, 718 bp, Zea mays
  misc_feature: Ceres CLONE 1575830
  misc_feature: Encodes the peptide sequence at SEQ ID NO. 88481
ctggagctcaccgcggtggcggccgctctagaactagtggatcccccgggctgcaggaattcgtctcacccctagaaaaaaaaaaaaaaaaaaaccctcgcaccctcaccgaaaggagaaggcttcagccttcaagcgcacacaggcacgcaaatcccctcttcatcaacctcgactcgagtccgcgcgcgtccccgaatcgaggggagatgagtcgtccgcatgacggtcacaggtccttctttcccatggggaatcccttcaggatgattctcccaagaggagcccgcctgccaccgaagctcactgagctgctcacttcgtatgaggatggcctggcctcgagcttgaggaaggtcaagccagaggccacctcagaggtgttcacactatcatggatgaagctcgcagtgggagtgcttatcagaagctgcacacccaatatagcccacccctgattactggagccttgaagctgccccttaccagactgggaagaaaaagggggggggaattttacctggaacagaaggggggaacctgcctgggaaatctgcatttgcccctaaacttcggaaaccccttccgggttgggatcaagggggaggctgccttggggcgaaaaattccccccggaaagggggggggaaaatcccggggggagggaaaaattggcccattcccaaaggaaacacgcctctcccgggaagaagcggga

SEQ ID NO: 88481 - protein, 82 aa, Zea mays
  misc_feature: Ceres CLONE 1575830
  misc_feature: SWISSPROT Homolog: EC 6.1.1.1
MSRPHDGHRSFFPMGNPFRMILPRGARLPPKLTELLTSYEDGLASSLRKVKPEATSEVFTLSWMKLAVGVLIRSCTPNIAHP

SEQ ID NO: 88482 - DNA, 841 bp, Zea mays
  misc_feature: Ceres CLONE 1575831
  misc_feature: Encodes the peptide sequence at SEQ ID NO. 88483
  misc_feature (816)..(816): n is a, c, t, g, unknown, or other
  misc_feature (817)..(817): n is a, c, t, g, unknown, or other
  misc_feature (833)..(833): n is a, c, t, g, unknown, or other
  misc_feature (841)..(841): n is a, c, t, g, unknown, or other
ctccccgcggtggcggccgctctagaactagtggatcccccgggctgcaggaattcgtctcacccctagaaaaacatccttgtagacgctactactttgctcaaaatccacctccgcctctcattgtcgacgtgaatctccttcaactttgattcgagatcaacaaaatccacaggaatatatctatcttgtactagctgacagagaagctccgccggagccagggaggtcgcaacgcagcgatatggaaacaaccgacgaggagaacgctctgcttcttcgtctccatcccactccgcaggtcgtagcttcggagtacgcaagtgatggttcagttgatatcaacaaacaacctgctctcaagcacagaacgggtaactggagggcatgctaccccgtcttaggtgttggattcagtgaaggcatggtgttctctgcaatcgcgacgaatttagtgacgtatctcaccactgtgctccacgagagcaaggtggatgcagcgaaaaatatctccgcctggtccggagtgtgcttcctcacgccacttcttggggctttcgttgcggacagttacttgggaaggtactggaccattgttgtggtcctcccggtctacatcgtggcaatgctcgtcctgatagcttcagcatcactcccggtattgttccagagcgacgtgcaccctgcagtggtttaccttggtctctaccttgccgccattgccagcggtggcgtgaagccctgcatttctgccttcggggctgatcaatttgacagcaatgacccgggcggaactggtgaagaagggctccttcnntcactggtactttctnctgacgan

SEQ ID NO: 88483 - protein, 198 aa, Zea mays
  misc_feature: Ceres CLONE 1575831
  misc_feature (191)..(191): Xaa is any aa, unknown, or other
  misc_feature (197)..(197): Xaa is any aa, unknown, or other
METTDEENALLLRLHPTPQVVASEYASDGSVDINKQPALKHRTGNWRACYPVLGVGFSEGMVFSAIATNLVTYLTTVLHESKVDAAKNISAWSGVCFLTPLLGAFVADSYLGRYWTIVVVLPVYIVAMLVLIASASLPVLFQSDVHPAVVYLGLYLAAIASGGVKPCISAFGADQFDSNDPGGTGEEGLLXSLVLSXD

SEQ ID NO: 88484 - DNA, 874 bp, Zea mays
  misc_feature: Ceres CLONE 1575832
  misc_feature: Encodes the peptide sequence at SEQ ID NO. 88485
  misc_feature (374)..(374): n is a, c, t, g, unknown, or other
ctggagctccccgcggtggcggccgctctagaactagtggatcccccgggctgcaggaattcgtctcacccctagaaaaagctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctgtggcgcccgggggatccatccgctgaccttaccctcgtaatcgccaaccgtatgcagaacatggtgtgtgtggnaaccatgatgcacctgacatgtacaaacatgccagtagagaagattgaccctgccctgggaaaacatcaaatcccatggggattcaaaatgttttgggccctccgaaggggatccctccccttgggcaaaaaaattttttggccaatttaaaggggggatttgcccttgggcccttgatttgggggccgccctttttagaaccccagaccggggggttttttttgggccaaacggggggggggggttatcccgaaggaccccccccctttgtggtttatggggggggagggggggggctcccttggggaaaaacaatataaaaaggttttttcccccctctaaaaaaaaaaagggggtgtggggggggggggcccccccctttttttgttccacactgtttttttttaaagaaacgcaacccctccctctcccccgggtgtggggaggaagccgccgccccccccattggttgtttttttttctcccccccctccgtgtc

SEQ ID NO: 88485 - protein, 65 aa, Zea mays
  misc_feature: Ceres CLONE 1575832
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITCGARGIHPLTLPS

SEQ ID NO: 88486 - DNA, 804 bp, Zea mays
  misc_feature: Ceres CLONE 1575833
  misc_feature: Encodes the peptide sequence at SEQ ID NO. 88487
ctggagctccccgcggtggcggccgctctagaactagtggatcccccgggctgcaggaattcgtctcacccctagaaaaactttgattttgctggtttgtgtaatagatcaatacatctcatcaaggaaagaagaaattcgggtattgtacctataggttcactgcaattaggtgtttgtaggcaccgagctgtcctaatgaagtatttgtgtgaccgggcggatcctccaattccttgtgagcttgtgaggggccatcttgactatacacctcatgcttggaacattgttcctgttaaaaagaggaatggctgggtaaggatgattgttgatgcttgttaccccaccaacataaaggaagagacagatccagagtacttttgcaggtatataccactcagtcgacttcaaattgtgctcgatgatgagggctatactcctcggtgctctttcccatctgtgtcatcatgcaaagaaattgaagttacaccttctagttctgtctatcactgtaaaattggtgctgttgatgctgctgcaaagatacgatatctggatactcgtagggtctcaaatgatgaagttaaactttttgaatacaagcttctgggggaagtaaggatgctgggtgcgctaaggaagcacagatccatagtggacatatatggacaccaactttcatctaaatgggttcaagtcgacggtgataaagaatataggatattgcagtctataattttaatgggaatatgtaaatggaggttctcttaaggtaaaaatcatttatcatgtttatggcttcct

SEQ ID NO: 88487 - protein, 190 aa, Zea mays
  misc_feature: Ceres CLONE 1575833
MKYLCDRADPPIPCELVRGHLDYTPHAWNIVPVKKRNGWVRMIVDACYPTNIKEETDPEYFCRYIPLSRLQIVLDDEGYTPRCSFPSVSSCKEIEVTPSSSVYHCKIGAVDAAAKIRYLDTRRVSNDEVKLFEYKLLGEVRMLGALRKHRSIVDIYGHQLSSKWVQVDGDKEYRILQSIILMGICKWRFS

SEQ ID NO: 88488 - DNA, 862 bp, Zea mays
  misc_feature: Ceres CLONE 1575835
  misc_feature: Translation starting site: 221
  misc_feature: SWISSPROT Homolog: EC 3.2.1.21 Beta-glucosidase
  misc_feature (408)..(408): n is a, c, t, g, unknown, or other
ctggagctcaccgcggtggcggccgctctagaactagtggatcccccgggctgcaggaattcgtctcacccctagaaaaaagcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccacacngccggggcccctccatctgggattcattcgcgcacgtcccacgaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaagggaaagtcaatccagaaagtgtagcgtattacaaaaattttgataactaatctgcttcagcaaggcatgacctccttacctcaaccttttaccactaaggatctttcctcttgcgcttgagaaaggaaatatggaaggggggtttaaaccccaaaaatgggcggacttgttttacagaataaggctgaacttttggttttaaaaaacctacggcgaaattccggaaaagacaacgggttttacactttcaatggagcccaggggaatt

SEQ ID NO: 88489 - DNA, 842 bp, Zea mays
  misc_feature: Ceres CLONE 1575840
  misc_feature: Encodes the peptide sequence at SEQ ID NO. 88490
  misc_feature (742)..(742): n is a, c, t, g, unknown, or other
  misc_feature (743)..(743): n is a, c, t, g, unknown, or other
ctggagctccccgcggtggcggccgctctagaactagtggatcccccgggctgcaggaattcgtctcacccctagaaaaagcctctggttttcttccaaagctgttatctctcgcacgcaaacgactagcgcaggcgcagcaaacaccccacctcgctcgcggtcgcggcacggcggcggcgatccaccgcggctcgctgccttcgccagtgatctggtctcttcgagtcccggcatcagataatcatccacagcccctcccctcctctcccagccccctcccttccccttccgctgaatcggcgcggagaggatggcgtcccggcggggcagcagcagttgcgtgctctgcgagggatccaacctgccgtcttgttgcgcctcgtgcgtcaacgcgaggctggtcgagtaccacacgaggctgcgcatgatgaggagcctccgcgactccctccacggccgaatcgccgcacgcctcgaagccaagagaaaaacagatgagcagcggatctggagaacaagcaaagaacaggatatcatggagttgaggaatcggctcactgaattgaagagaaaaactgccgtagacaagaccgaggtcgagcaggcatcgagtgatctcaaggcaaaaactgtgccattgaatttggctcttgccacgctaaaaaagagacgagctgatgcagtggccatgcacaccaatgccatgaaaagtgctcagatgaatctcatggcaccaccnntcagatgtatgaaaatgcaatcaaaatctgtaaagcaactttgcagaatgtttcccaatgcgacgaggtattaaagagggagaaaagaaagacggctac

SEQ ID NO: 88490 - protein, 167 aa, Zea mays
  misc_feature: Ceres CLONE 1575840
  misc_feature (144)..(144): Xaa is any aa, unknown, or other
MASRRGSSSCVLCEGSNLPSCCASCVNARLVEYHTRLRMMRSLRDSLHGRIAARLEAKRKTDEQRIWRTSKEQDIMELRNRLTELKRKTAVDKTEVEQASSDLKAKTVPLNLALATLKKRRADAVAMHTNAMKSAQMNLMAPPXRCMKMQSKSVKQLCRMFPNATRY

SEQ ID NO: 88491 - DNA, 926 bp, Zea mays
  misc_feature: Ceres CLONE 1575845
  misc_feature: Encodes the peptide sequence at SEQ ID NO. 88492
taagctggagctccccgcggtggcggccgctctagaactagtggatcccccgggctgcaggaattcgtctcacccctagaaaaaactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaagacctcttcctcatctggctcgtcaccatcacctgcaccctgccgatccagtctctgttccccttcttggatttcatgataagggatctgcatattgctaaaaaaacacaagaaattggattttatgccgggttttgttggcgcctccaaaatgtggggggagggcagtcccccccaccaatagggggaatccgcgcgtgaaaagcttgggaaggaaaacagttatcgtaactgacccctattggaaaaataatcttcaaatacaagtttgggaaaaaacccaaaccttgggaggggttttaccccccaggcccccgtgggaaaaaggggggggggaatccggggcaataaaggttgatccacaaaagggtgccaaaaaaaaaaaaaccccgggtcggaaagggtttttcccacaagaggagggcccaaaatggtccccccttgtgggtgtttctcggccacccccaaaaaatccacattcaacccccacgccctttgggggggtgcccc

SEQ ID NO: 88492 - protein, 112 aa, Zea mays
  misc_feature: Ceres CLONE 1575845
MGGGNGETTQLGEPLLAKKAKAYRPRCPGCRVDRLNAEREGVFPLKDLFLIWLVTITCTLPIQSLFPFLDFMIRDLHIAKKTQEIGFYAGFCWRLQNVGGGQSPPPIGGIRA

SEQ ID NO: 88493 - DNA, 953 bp, Zea mays
  misc_feature: Ceres CLONE 1575848
  misc_feature: Translation starting site: 201
  misc_feature: SWISSPROT Homolog: EC 4.3.1.5 Phenylalanine ammonia-lyase
  misc_feature (757)..(757): n is a, c, t, g, unknown, or other
  misc_feature (782)..(782): n is a, c, t, g, unknown, or other
  misc_feature (864)..(864): n is a, c, t, g, unknown, or other
ggagctccccgcggtggcggccgctctagaactagtggatcccccgggctgcaggaattcgtctcacccctagaaaaaaagaagagcacgcccactcctctccggctcctcttcttctccaccacaccacaggcaccggcaccggcaccgcctcctccctccctcctgccaccgcgcggcaccccagccacagcacagcaatggcgggcaacggcgccatcgtggagagcgacccgctgaactggggcgcggcggcggcggagctggcggggagccacctggacgaggtgaagcgcatggtggcgcaggcccggcagccggtggtgaagatcgagggctccacgctccgcgtcggccaggtggccgccgtcgcgtccgccagggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctgcaggtcgagctgctcaggcatctcaacgccggaatcttcggcaccggcagcgatggccacacgctgccgtcggaggtcacccgggcggcgatgctggtgcgcatcaacacgctcctgcagggctactccggcatccgcttcgagatcctcgaggccatcaccaagctgctcaacaccggggtcagcccgtgcctgccgctccggggcancatcaccgcgtcgggcgacctggtnccgctctccacatcgccagcctcatcacgggccgccccacgcgcaggccgtcaccgtcaaacgcaggaaggtgacgcccccnaagcgtttcagatcgccggcatcgaaggcggcttctcagctcaaacccaagaggcctcgcatcgtcaacgcacctccgtgggctcgcgc

SEQ ID NO: 88494 - DNA, 1026 bp, Zea mays
  misc_feature: Ceres CLONE 1575851
  misc_feature: Encodes the peptide sequence at SEQ ID NO. 88495
  misc_feature (506)..(506): n is a, c, t, g, unknown, or other
  misc_feature (548)..(548): n is a, c, t, g, unknown, or other
  misc_feature (575)..(575): n is a, c, t, g, unknown, or other
  misc_feature (593)..(593): n is a, c, t, g, unknown, or other
  misc_feature (599)..(599): n is a, c, t, g, unknown, or other
ctggagctccccgcggtggcggccgctctagaactagtggatcccccgggctgcaggaattcgtctcacccctagaaaaagcctaccccgtccctccccagcgcgccgtctagggtttcacagcggtgccccgatccattcgagcgccccgcaccgccgccatggagtttgacgaatacgagtacttggagaaggcggtggagcccgctcctccacaggccaatggttccggctccggctccggcgagaaggaccggggctcgcgccgccgcgagggcggcgaggaccgcatatcgaagcgctctcgctcgggggaggaccgcgaccgggacaggcaccgcagcggccgggagcaccgtgaccgggacgggattgacgtgaaggaggagaggagccgcgaaagccgcggggaggacagttacagggacaggagggggagagtaacggtagaaggagaaggggagacaggcatcggctgagagagaggggaagtggaacggggagcngtaggaccgggatcctctcggggcggcgccgtggccgagaangaagaaattggtttagggaactgggancggggaccccaaccccanctagcnaattcccttttcgcgacccggtgatgtccgattttgaatccgaatagagcccgcctttcaaaagggttcctggcaatttgggcccgtaccccaagaatttcggggctttagaaaaaaaataccggcgcaaaaccccaaattttgttccccaaaaagggacccaagggaacgggtttttcccttcccacctttctttttgaggggacaacaaaaaaaaatttttttaaagtccccccccaagggggggggaaaagcccccgaaatttcccccttttttgggggccaaaaaacccaaaatttttttaagggggtgggttgtcccccccaaatttttatatttgtgcccacccgcgggggtattccgcctttttcacaaggagaaggaatttaatatctttttgggtgacaaaaccgcgaggaaattttt

SEQ ID NO: 88495 - protein, 105 aa, Zea mays
  misc_feature: Ceres CLONE 1575851
MEFDEYEYLEKAVEPAPPQANGSGSGSGEKDRGSRRREGGEDRISKRSRSGEDRDRDRHRSGREHRDRDGIDVKEERSRESRGEDSYRDRRGRVTVEGEGETGIG

SEQ ID NO: 88496 - DNA, 827 bp, Zea mays
  misc_feature: Ceres CLONE 1575852
  misc_feature: Encodes the peptide sequence at SEQ ID NO. 88497
ggagctccccgcggtggcggccgctctagaactagtggatcccccgggctgcaggaattcgtctcacccctagaaaaaaaaaaaaaacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgaggccgacgcgcgcaagcgcaggaagggcccgctgtacaagctcaaggcggcgatccagggcctcgcgggatcccgctcccgcgcgccgaagtgtacgggggagagtaccagtaccagcgcgccgtcaagaaggcggagagaatattctctcgggtgctactcagctaggcagaattgttaccctatgatgagcaccggggtttacctgggggttggattccagctgtcaggggggaaacgccaaatgaacaaactaatggggaaaaaccgggcttgggggggggaatttcgggcccaaggaaaggggcaaaaaggggcccaaaaagaaaaccgggaaaaggggaaccccccaaaggtggctttaaagggggaaaccaaaaagggggtgtgaaaaaaacccctggcccccgaaaaattttcctttttgggggaaa

SEQ ID NO: 88497 - protein, 191 aa, Zea mays
  misc_feature: Ceres CLONE 1575852
MAAAAAAAVAHLSIHGRLRRSPEHRPSITTTTTSSSSPSAHRPSLLRCRAFKQEASDGDPAEADARKRRKGPLYKLKAAIQGLAGSRSRAPKCTGESTSTSAPSRRRREYSLGCYSARQNCYPMMSTGVYLGVGFQLSGGKRQMNKLMGKNRAWGGEFRAQGKGQKGAQKENREKGNPPKVALKGETKKGV

SEQ ID NO: 88498 - DNA, 823 bp, Zea mays
  misc_feature: Ceres CLONE 1575853
  misc_feature: Encodes the peptide sequence at SEQ ID NO. 88499
ctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatccgcatgaccaagtccgaccttgtcaacaacctcggtaccatcgccaggtccgggaccaatgagttcatggaagcccttgctgccggcgctgatgtgtccatgattggccagttcggcgtcggtttctactctgcctacctcgtcgccgatagagttgtcgtgaccaccagcacacgatgaccaagcgtacctgtgggagtcccaagcgggcgggtcgatccctgttactcccgacacctcaggggagcagcttggcagggcactaaaaatacactgttccttcaggacaatccgctggagtacccttgagggagcgtcccctcaggaatttggtcagaaaacaattttgaggttataagctacccccatctcccttgggggatgaaaggacaaccgaaaaaggaatttttttgacacacgaac

SEQ ID NO: 88499 - protein, 143 aa, Zea mays
  misc_feature: Ceres CLONE 1575853
MASETETFAFQAEINQLLSLIINTFYSNKEIFLRELISNSSDALDKIRFESLTDKSKLDAQPELFIHLVPDKATNTLSIIDSGIRMTKSDLVNNLGTIARSGTNEFMEALAAGADVSMIGQFGVGFYSAYLVADRVVVTTSTR

SEQ ID NO: 88500 - DNA, 932 bp, Zea mays
  misc_feature: Ceres CLONE 1575854
  misc_feature: Encodes the peptide sequence at SEQ ID NO. 88501
  misc_feature (836)..(836): n is a, c, t, g, unknown, or other
ctccccgcggtggcggccgctctagaactagtggatcccccgggctgcaggaattcgtctcacccctagaaaaactcacaaactgccttttcttccggcttccaacttccaagtggcgactgctgccgactgccgggtgcgagaagagggagagatcagagtatcagacaagctgttgtccgaatccactccggcgaggacgagtgctgaggtcgaaatggggagaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctactcgccgagggcgacgactccacgcgccacgtcatctccgcgctgctacgcaagtgcggctaccgagttgctgcagcctctgatggtgtgaaggcgtgggacatattaaaggaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcatcagatttccttgttaagccgctcagaaagaacgaattaacgaacttgtggcagcacgtttggagaaaacaactggcaaacggtgggcccgatgtgcagcacatacaagaagagaatcttgcagatagaatggaacagaagactggcgtgacaaaagatgataatttgaacagcgatggtccctgtaaaaatnaagatgcagtgaacaagaaaggatgctcaaagtctttggacaggtcagaagtggaagctgaaactaagcaactgacacattctggagatatgccaa

SEQ ID NO: 88501 - protein, 238 aa, Zea mays
  misc_feature: Ceres CLONE 1575854
  misc_feature (44)..(160): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature (207)..(207): Xaa is any aa, unknown, or other
MGRGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGASDFLVKPLRKNELTNLWQHVWRKQLANGGPDVQHIQEENLADRMEQKTGVTKDDNLNSDGPCKNXDAVNKKGCSKSLDRSEVEAETKQLTHSGDMP

SEQ ID NO: 88502 - DNA, 949 bp, Zea mays
  misc_feature: Ceres CLONE 1575856
ggagctccccgcggtggcggccgctctagaactagtggatcccccgggctgcaggaattcgtctcacccctagaaaaaatatcgcacaccatcgcgagcttcccccatgagatctatcctgtttctcgtaggcacaacttgcctatatacgaatcttcttcacctaacgtggcagactcttttatattgtggcactttaagatcagacgatcgcccccctgctgcattcgctcactttcaacgaaacggaggccactaatggggactccatgctctctatcctgaatttgaggatggagctgaaaaacctatcacacatctgtctcacagatattattgaacggatcgcgctatatggtgtgaaaatcatcacatgaatgtatgtcctctacctcccccacccggaaagaactgccttaatttttgctatcaccgacaaatgggattactgaaaaccggttactcacaggtaatggcatatatatttggacaactctccccggaccatgcgatcacggttaaaaatcccccaaaatgaaactggtcgaccctgacatcatgcctttggaaatgggcttcctaaattatttccacgtcccccttgtttaaacaataggatggccattttctatttgcagacaactgcggtggtaattttattagggtcaaaacccttgaaacaatactcccctttttcccctgggaactaattaaaggttgagagatttcctccctgaaaacaacttttttagtggggggaaaactttcttccggctttaaaaggattccccccaaaaagcgtgttttttgaaaaaaacgggaaaccccctacattcttgagttggaaaaaaaattgcctttccaaacaacatttcccattgtaattcaaaattgccgcccccccgaatataccacttttttgggggcctgtcaaaatcttgggaattag

SEQ ID NO: 88503 - DNA, 961 bp, Zea mays
  misc_feature: Ceres CLONE 1575857
  misc_feature: Encodes the peptide sequence at SEQ ID NO. 88504
  misc_feature (846)..(846): n is a, c, t, g, unknown, or other
  misc_feature (904)..(904): n is a, c, t, g, unknown, or other
  misc_feature (933)..(933): n is a, c, t, g, unknown, or other
ctggagctccccgcggtggcggccgctctagaactagtggatcccccgggctgcaggaattcgtctcacccctagaaaaagcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccacttcctccctatccatcgtgaagcccctgcttttcgtgagcagggcactgagcagcaaattcttgttactgggatcaaaggtcgtggatcttcttgcaccctaccaaagagtggaaaaaatggtctattcggtggtgcangagtgggtaaaactgtgctcattatggagctaaatcacaatgttgctaggcccatggntggttctctgtgtttgctggtggtggagnaactacccgtgaagggatgacctgtcag

SEQ ID NO: 88504 - protein, 265 aa, Zea mays
  misc_feature: Ceres CLONE 1575857
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (231)..(231): Xaa is any aa, unknown, or other
  misc_feature (250)..(250): Xaa is any aa, unknown, or other
  misc_feature (260)..(260): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFLPIHREAPAFREQGTEQQILVTGIKGRGSSCTLPKSGKNGLFGGAXVGKTVLIMELNHNVARPMXGSLCLLVVEXLPVKG

SEQ ID NO: 88505 - DNA, 2203 bp, Zea mays
  misc_feature: Ceres CLONE 1575860
  misc_feature: Encodes the peptide sequence at SEQ ID NO. 88506
aatccaaccgcacaagaattgcatcatcatcgttagctgccacagatggagatcttccaagtgacgacgatgatcctgcagcatccgttactcacatacttcttctctgcactcctgctcacacagctgctgacggcgcctactgcggcggcggagacaacggtgaaagtgagcaccacccctatcttccccgagatcccacaaggccaggcgagaaaggacttccaagtgctggtgcgcgtcgaggcgccggcgcgtccagaggcgcgcatccccatcgacgtcgtcgccgtcctcgatgtcagcggcagcatgaacgacccggcggcagcgccgacggagagaacgagaacgacgtcgaggctggacctgctgaagacggccgccaagttcatggtcgcgaaactcgaggacggagaccgcctctccatcgtcgcgttcagcgatcggccagtcagagaactgagctccggcttgctgtacatgactgctgacggccggaggaacgccattaggagcttggaccagctggaggcccgcggcggcactgcgctcgtgccggccttcgaggaggcggtgaaggtcctggacgggcggcagggagacggcggggaccgcctgggcttcatcgtcctcctcacggacggcgccgaggatgcgagcgggtcgttcacgctgagcgagcgccgccgcgaggtgatccgaggcgccctcggcaggtaccccgtccacgcgttcggcctcggcacggcgcacggccccgaggtcctgctgtacctggcccaagagtcccgcggcacctattccttcgtcgacggcgacaacgtcggcgaggtggccggcgccctcgccgtgtgcctgggcgggctgaccaccgtggccgccgtggacacgcgcgtggtcctcagggccgacgagctgaacggggtgcgcgtagaccgcgtcgactccggcggccacgacagcagcgtcagctgcggcgggacctcatgcgaggtctccgtgggcgtcctgtacgccggcgaggccaagcatttcgtggtccacctccacgtgccagctattactgcgacggcctcggcgtcaacggagggcggttactactgcgacggcctcggcgtgtgtgaccactaccgccaccaccgccaccaccgccacgggcagcacctgctcgccgtcggctactcgtaccgcagccatccgagcgcccgggcgatcacggtagaagcgcacggcgtgttcgtgcagcggtcaccggcggtgttagacttagacggcgggcggcacgctcctgttattccctccccctcccccgtggtcctgcagcacatcgtccggttcgagctgctggaagtggtggcaaacagcctcgtccgcggcgagctgatcagcaacgacgacagagagcgtgccgcggacatgctgcaggtcaagtgggaggagttcagggcgtgccaccagttctggggtggcgggctcctcgacctgatgagcggcctggagaaggaggtggacggcatggtgagcagcctcagggcgggggtggcggcgtacgtctacgcctgggtatcgagccaccagatgcagcgggccaccagcatcggctcgccggacaaggcggccgtcgagttcctgacgccggcgatgcggctcctgttggaggaggcgcgaaagctgccgcgctggcagcaggctgcaacgacgacggcggcgcccacgaacttccagtacgcgggctgcgtcggcggcggcggcttcgagatggtggaccggaggctggagctgtggtccaagatgaagcgcgacgtgcagctcctcgtgtcggtccaggagcaggcggtggcggacgaagaggagcagcacctcgccgccgtcttccaggaggcatcgctggcggccatcgaccgcgcgatgcaccgcgacatttacctggccgcggtttatgcgagcaagcagacgcgatgccactcggtcgggtgccaacaagtgaaggactgagaactcgatcggcaccagtagattaagtgggcatgacgtcaataataactaattaattacgtacctagccgcttgtactagtcatgccctactttattactttaaaagatacatttcgttgtgtaatcatcttatggttcaccatcgtcatgtgttccaatatatactgtctcatatctatattcatcaaaaaaaaaaaaaaaaa

SEQ ID NO: 88506 - protein, 650 aa, Zea mays
  misc_feature: Ceres CLONE 1575860
  misc_feature (79)..(268): Pfam Name: VWA Pfam Description: von Willebrand factor type A domain
MEIFQVTTMILQHPLLTYFFSALLLTQLLTAPTAAAETTVKVSTTPIFPEIPQGQARKDFQVLVRVEAPARPEARIPIDVVAVLDVSGSMNDPAAAPTERTRTTSRLDLLKTAAKFMVAKLEDGDRLSIVAFSDRPVRELSSGLLYMTADGRRNAIRSLDQLEARGGTALVPAFEEAVKVLDGRQGDGGDRLGFIVLLTDGAEDASGSFTLSERRREVIRGALGRYPVHAFGLGTAHGPEVLLYLAQESRGTYSFVDGDNVGEVAGALAVCLGGLTTVAAVDTRVVLRADELNGVRVDRVDSGGHDSSVSCGGTSCEVSVGVLYAGEAKHFVVHLHVPAITATASASTEGGYYCDGLGVCDHYRHHRHHRHGQHLLAVGYSYRSHPSARAITVEAHGVFVQRSPAVLDLDGGRHAPVIPSPSPVVLQHIVRFELLEVVANSLVRGELISNDDRERAADMLQVKWEEFRACHQFWGGGLLDLMSGLEKEVDGMVSSLRAGVAAYVYAWVSSHQMQRATSIGSPDKAAVEFLTPAMRLLLEEARKLPRWQQAATTTAAPTNFQYAGCVGGGGFEMVDRRLELWSKMKRDVQLLVSVQEQAVADEEEQHLAAVFQEASLAAIDRAMHRDIYLAAVYASKQTRCHSVGCQQVKD

SEQ ID NO: 88507 - DNA, 933 bp, Zea mays
  misc_feature: Ceres CLONE 1575865
  misc_feature: Encodes the peptide sequence at SEQ ID NO. 88508
  misc_feature (690)..(690): n is a, c, t, g, unknown, or other
  misc_feature (697)..(697): n is a, c, t, g, unknown, or other
  misc_feature (698)..(698): n is a, c, t, g, unknown, or other
  misc_feature (736)..(736): n is a, c, t, g, unknown, or other
ctccccgcggtggcggccgctctagaactagtggatcccccgggctgcaggaattcgtctcacccctagaaaaacccaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgtgcgtgccgtttcctactccctggtttgcttgcggtgtctgtttatcttttcgctgtgccatagtatattgttccgggttttgccggactagagaaaggatctatatcggggcgactaatccatttgaaactaaaatagacttttagttttgtatttgacaatttagagactaaaataaaataaaacgggggactaaaaattaatcgaaaccaaactcccccttagtctgctctgcactgttctatttttggttggatttggatactggtatattttccattactgtgactactatggaattttnagttggnntcgataggggacagacagtgcattaggtgcaggattangatttttgccggtactgggactgttcttgtctttttcccaggaacaccttttatggaggctagggatttttttttttttttttttttttgcccggaagggctccctgggggttaaaaaaaaaaattttcccattggggaggggaaccccccaacccccccttttttaaaaaaataacacgggggctcctatctatat

SEQ ID NO: 88508 - protein, 111 aa, Zea mays
  misc_feature: Ceres CLONE 1575865
  misc_feature (9)..(59): Pfam Name: SRF-TF Pfam Description: SRF-type transcription factor (DNA-binding and dimerisation domain)
MGRGKIEIKRIENSTNRQVTFSKRRNGILKKAREISVLCDAEVGVVVFSSAGKLYDYCSPKTSCVPFPTPWFACGVCLSFRCAIVYCSGFCRTRERIYIGATNPFETKIDF

SEQ ID NO: 88509 - DNA, 887 bp, Zea mays
  misc_feature: Ceres CLONE 1575866
tccccgcggtggcggccgctctgaatagtggatcccccgggctgcggattcgtctcacccctagaaaaatgccgtaacccgcaggctcccggcatctcgctcttgcctccaaaattcatccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgaggctgttgccctccccgggcgcccctcggggcggagctcgcacgcgtccctgcgaggcgcgcggcgccgctgaagcaccggggcgcgccggggggaaggaaccaagttggaaattagggcccggaaccagaggacaggggagggaaccctaaaatttccaggccccaaaaggaccacaaagccccggaaggttttcttttttctttccccccgccaaagaaaaagaaaggggcaaaaaattttcctcggggcttttccccccaagagtttccgcgaaccgaaaaaaaagaggggcggggaaattttccgggaaaaaaaaatggccaaagaccccccccgccttgtaaagaggggggggaatttcccgggggggggcccccacagaaaacacccttttgggccttttggggggtattaaacacccccgggggggtttaaaaaggggggaacccttttgcccccggcgcggggaaccccccagattgagaaaatccccaaaaaaaccttttttccctctccgccaaaaaaaagtagat

SEQ ID NO: 88510 - DNA, 776 bp, Zea mays
  misc_feature: Ceres CLONE 1575870
  misc_feature: Translation starting site: 143
  misc_feature: SWISSPROT Homolog: EC 1.14.99.9 Steroid 17-alpha-monooxygenase
  misc_feature (731)..(731): n is a, c, t, g, unknown, or other
agctcaccgcggtggcggccgctctagaactagtggatcccccgggctgcaggaattcgtctcacccctagaaaaaaccccaccaccaagactctaggcgcagcagctcctccacgcttcgctgccgggtcaagctcctgtcatggagatcacggccagctgcgacgacggcgcggtcaccgctggcgccgtttctggtgtgctgctcgcgtctgttctgtctctgttcggcgcgtttctggtatacttctacgcgccgttctggagcgtgaggagagtcccggggcctccagccaggttccccgtcggccacctccatcttcttgccaggaacgggccagacgtcttccgtgcgattgcgaaagagtatggcccaatcttcaggtttcacatgggaaggcaaccactggtgatcgtggccaatgccgagctgtgcaaggaggtcggcatcaagaagttcaaggacatccccaaccggagcaccccgccgccgtcgatcggttccctgcaccaggacgccctcttcctcaccaggtgcacgcactggtccatccttctaggtagaccgaaatgctagctagctccatctcagatagagaaggcatgggaagttttgttgattgtgaggcacttacttgtatgatctacgatggcagggactcgacgtggtcggcgatgaggagcacggtggttccgctctaccagccagcgcggcttgccgggctcatccnggtgatgcagtcgtacgtcgacacactggcggcgaaacatcgcgc

SEQ ID NO: 88511 - DNA, 932 bp, Zea mays
  misc_feature: Ceres CLONE 1575873
  misc_feature: Encodes the peptide sequence at SEQ ID NO. 88512
ctccccgcggtggcggccgctctagaactagtggatcccccgggctgcaggaattcgtctcacccctagaaaaatttttccaaatccgtctacgccctcacgcacgcggcccaactagcctaacaaaccctagctagaaaaatagaaaaactagattaaagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagacaaagatcgcgatcgccaccacagggaccatcgagagcgcagcgagaaaaggggaacacgtgatcgttctgatgatcgtggacgtcaccgtgatggtcgtgaccggcaccgtgatgatcgtgattctgagagggagagagatcgtgacagagatggtcatcgtaggcatcgctcccgctccccttctaaaatcgtgaccgtgacgcagatctaaatctcgtcacgcccccgatcaaaaacaaaggccgtgatgggttttgacaagcacctcaaaaagggacttccaatggttggcggcggggctatccccggcaagtttccgggaaccggccccattcccggggttgggggctccaaacttggtaatttggggggggaaattccaccct

SEQ ID NO: 88512 - protein, 116 aa, Zea mays
  misc_feature: Ceres CLONE 1575873
MRHNHMTVVPRNLEKGTENAIRARIGSVTGIVAEKRGGTETGIRIVKEVTETKIAIATTGTIESAARKGEHVIVLMIVDVTVMVVTGTVMIVILRGREIVTEMVIVGIAPAPLLKS

SEQ ID NO: 88513 - DNA, 827 bp, Zea mays
  misc_feature: Ceres CLONE 1575876
  misc_feature: Encodes the peptide sequence at SEQ ID NO. 88514
  misc_feature (470)..(470): n is a, c, t, g, unknown, or other
ctggagctccccgcggtggcggccgctctagaactagtggatcccccgggctgcaggaattcgtctcacccctagaaaaaatccatccagccgtctcggggcagccaagaggtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggcttttgtgcggtggcattttatggatgatcactatccctgtacgaagtgcattttctcttctgaatcanggttctttgatgagtacccagaaggcttttgggggaatcctggaaatctgctactgcagatgggactcaacagtgggctttcctggacagacgccttggcaggatttcaggttaaaccttttatgtgaaaactaagtactttctggccatgtggtgattggatctaagtttggataaatatcaccctctattggtggcggtaataactttggggtgttgttcacaaaaaaggggtgatcccaaaaaaatggtttggttttggggaacttcatggcaaaccaatttgtttattttgaaccccccagattgggtttttgggatggccttattggaaaaccttattggaataattgggga

SEQ ID NO: 88514 - protein, 153 aa, Zea mays
  misc_feature: Ceres CLONE 1575876
  misc_feature (109)..(109): Xaa is any aa, unknown, or other
MKITALLVLKPSTSGAGSSSSGGQSGPEAVVLANATDVSHFGYFQRSAAREFIVFVARTVAQRTQPGQRQSVQHEEYKVHSHNRNGLLCGGILWMITIPVRSAFSLLNXGSLMSTQKAFGGILEICYCRWDSTVGFPGQTPWQDFRLNLLCEN

SEQ ID NO: 88515 - DNA, 958 bp, Zea mays
  misc_feature: Ceres CLONE 1575877
  misc_feature: Encodes the peptide sequence at SEQ ID NO. 88516
ctggagctccccgcggtggcggccgctctagaactagtggatcccccgggctgcaggaattcgtctcacccctagaaaaaaggtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggaggaggtgtggaaggagatcaccggcggaggtggcagtggggaacccgtgccccccgtggcggctcaggctgccgtccccgctggtggtggtggcgccggcggcccggagatgacgctggaggacttcctggccagggaggagggcgcggtgaaggaggatggggtttagggtttcgggcccctctgcgccggccatggggttcctgggcggagcggagggcgtgcgtgtgcctggaagcggatgccatggaggaagacgcgagagtgcttgatgagtaagacgggcttctggggtcgatttgcttctgagttgttattttatatcgtcacaatttcgggttggtcgttgggtattctgtgagcaaccaaccaggctattggtatgaaaatgtgtcgtctgttagcagggaaacttccgatggtgcccctgctggaacactccggaataataaatatgcacctctaggtggtcacctgcgtctcccaaatgagcatgtaccttggaggaatatctgggaaccctttgtgttatgaaaagaattgttttttcacaa

SEQ ID NO: 88516 - protein, 136 aa, Zea mays
  misc_feature: Ceres CLONE 1575877
MASSRVMPSSSPSHTASDLARLAQAASRPGGGGSGLGSMNVEELLRGIYSDMPTPAPPASEPERPRSPAPAPEVATRRTAEEVWKEITGGGGSGEPVPPVAAQAAVPAGGGGAGGPEMTLEDFLAREEGAVKEDGV

SEQ ID NO: 88517 - DNA, 844 bp, Zea mays
  misc_feature: Ceres CLONE 1575882
  misc_feature: Encodes the peptide sequence at SEQ ID NO. 88518
  misc_feature (844)..(844): n is a, c, t, g, unknown, or other
ctccccgcggtggcggccgctctagaactagtggatcccccgggctgcaggaattcgtctcacccctagaaaaaggtggaaaactttggaggcgcccaacttccaagatacccactagctcccagcctcccaccttgccctttccacccttcgctgatgctagctaggatgatgggatttttggagctctaagacaagtactactgatccttgcgcttcacacgccctcttgctccctgcgtgttcttgattcggcctcaaaatttgttgcctgttttctcgtgtttgaggtgatatctcggttctaaaaatctgccagatttcttctccctgtttgtatggacaaatttgggaacgaaccctagtctgtgtgtgtgaagcagccaaagtggcgttcttgcggagcaaagctaaagcggcagcagttggtgaggatacaggagaagatacagaagggcttgttagattctgtaaagacactcttattagctgatattttttccatcaactggggccggtttttcggaagtacgcccctcttggattaaagcctctcaattttaggattcggcacaagcacaataccatcaagtgaacaagagccatttggtcttgggcatggagaagcaatccagcacccggcatggtgccctagagaaattgaagagcttccgggggatagagaagcagagaagcttcaagttcttgtccatggagaagcagcagagcttcaaaaggaacaaggacagcccctgggaagcggggtgacaccgcactccaccttgcggcgagggctggcagtgttgcgcatgtgcagaggatcccttgcggagtgtgatccagn

SEQ ID NO: 88518 - protein, 49 aa, Zea mays
  misc_feature: Ceres CLONE 1575882
MEKQSSTRHGALEKLKSFRGIEKQRSFKFLSMEKQQSFKRNKDSPWEAG

SEQ ID NO: 88519 - DNA, 709 bp, Zea mays
  misc_feature: Ceres CLONE 1575886
  misc_feature (294)..(294): n is a, c, t, g, unknown, or other
  misc_feature (342)..(342): n is a, c, t, g, unknown, or other
  misc_feature (355)..(355): n is a, c, t, g, unknown, or other
ctggagctccccgcggtggcggccgctctagaactagtggatcccccgggctgcaggaattcgtctcacccctagaaaaagaggacatcctcggccttccagggcagcaaccacgaaagccttctgcgcggggtgctttcctcgcagcaaatattcctgccttttgcattccggctttgcaagttccttgctttgggcatatatattgtgaggtctctatatatataggtggttcgaggtgatcggcagaaccacacaggcaaagatggcgagcgtgcacaaggccaccacccnttgttctcatgttctgcctgctagcgctgggggagagcggaagtaccntcaagtacaaggnaccccgaagcagcccccgtcgctgtttcgcaatcaaggaacctgctgggggtcggaattaactcttcgcttaaaaaaaatcggcccagaattaacccccaaattcggaaaggggaaaaaaaccccccggggcccaaaaaaagccccctttggggcaaaaaaaaatttttttaaaaaaaaaaaacccggtgcttaaaaaccgggggaaaaaagaaaaaaatttttttcctcctctttccctctacagggggggggttttttctttcaaaaaggggtggtggggggggccccccccccccccggggggggggtgaccccccccccccaaaatttttttaaaaaaagagagggggga

SEQ ID NO: 88520 - DNA, 956 bp, Zea mays
  misc_feature: Ceres CLONE 1575889
  misc_feature: Encodes the peptide sequence at SEQ ID NO. 88521
  misc_feature (62)..(62): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
aagagacaggtaattacaggtgaaagagaagtataaaaatctcgggagcgacctccccctcnccccccccaannnnnacaaaactgggactccccgcggtggcggccgctctagaatagtggatcccccgggctgcaggaattcgtctcacccctagaaaaagaggacatcctcggccttccagggcagcaaccacgaaagccttctgcgcggggtgctttcctcgcagcaaatattcctgccttttgcattccggctttgcaagttccttgctttgggcatatatattgtgaggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtccgggcttggagctaccaggggaccctgaacctcggttaagagaattggagaaagcaaactgctcttgaagtttagagctacttggaattcctttacgccctttgctaccctgtaatagcgggttttgtaagagatcccagcatggggggacgactgtcttatgagaagcctcaagagggaggaatcccaaaaggtttggtccca

SEQ ID NO: 88521 - protein, 147 aa, Zea mays
  misc_feature: Ceres CLONE 1575889
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMQKGALSTRLGIPIIYGIDAVHGHNNVYKATIFPHNVRAWSYQGTLNLG

SEQ ID NO: 88522 - DNA, 921 bp, Zea mays
  misc_feature: Ceres CLONE 1575892
cggccgctctagaactagtggatcccccgggctgcaggaattcgtctcacccctagaaaaaaagcccacccagagctctgtagaagagaggggaggaaggaccgaggaccaaccggagccccactcggccgccgcctctcacctccaccgactgcctgcgtcccaccgctcctgctgccgcccgttgctctcgccattgaagccctcgccgcctccgcccgcttgcccgccctcccgtcggctgccttccggatgagaagcggcgcaacctgggcggtggaagcgtggtcggcctgagccttcgtgggggttagcgccgagaaggatcctggagattaagcgcatgggttccttggaggcccggtacaggccggccggggcaccaccctgccacatctcagtgaatttcatctccttccgaggcagagtattaaataaatataagatcaatgcaatcttctagggaaggtaaacaccaacaccagtaccatttatttgttatctttttaaactaagggccaaagaagtataagttttgttaccctctgacctgggggtggtccttttcaacaggtatacttggaaaatttttcttggcatgggaacctggtgaaaaaaaactggggttggctaacactgggggggttaagggaaaatccacagagggatccccttgaggccggggagattgaccactttttttgcctcgcagcagattttgcccaacctggaaaaattccttccccccaggggggaaaagttgctgcactttcttgtggacccagagtaaattggggtttggaaacaccttgcatggtggagggtttaccattctcggggagattgaaaaatccttttggctcttccagacagaaacagttgttgtgaatacagaatgagcaaaagatggggtggggtggg

SEQ ID NO: 88523 - DNA, 890 bp, Zea mays
  misc_feature: Ceres CLONE 1575897
  misc_feature: Encodes the peptide sequence at SEQ ID NO. 88524
  misc_feature (749)..(749): n is a, c, t, g, unknown, or other
  misc_feature (780)..(780): n is a, c, t, g, unknown, or other
  misc_feature (787)..(787): n is a, c, t, g, unknown, or other
  misc_feature (844)..(844): n is a, c, t, g, unknown, or other
  misc_feature (851)..(851): n is a, c, t, g, unknown, or other
  misc_feature (862)..(862): n is a, c, t, g, unknown, or other
ctggagctccccgcggtggcggccgctctagaactagtggatcccccgggctgcaggaattcgtctcacccctagaaaaactcccctcctccccatcgcgtcctctccgctacacctcgccgatcggatcgcgacgagacgccgcgcgatccgacctaggctgacgccaacgaccactctcgccgccggcggtcatggcgtacggcgaccgcgttaccaccttcgaggactcagagaaggagagcgagtacggctatgtccgcaaggtctctggacctgtggttgttgctgatggaatgggtggtgctgccatgtatgaacttgtccgcgtcgggcatgataacctcatcggggaaattatccgtcttgagggcgattcagctacaatccaagtttatgaggaaacagctggactgatggttaatgaccctgttttgagaacgagaaagcctctatcagttgaattgggacctggaattcttggaaatatttttgatggtatccagcgccctctaaaaaccattgccattaagtcaggagatgtgtatattcctcgtggtgtttcagttcctgcccttgacaaagatgcattatgggaatttcagccaaagaaactaggtgttggagatgtcatcacaggtggagatctatacgctactgtctttgagaacacattgatgcagcaccatgttgctcttccaccgggttctatgggggaaaaatagtacattgcaccagctggtcagtancaccttcaggacacagtgctagaattggaanttcaggncataaaaaagaattttaccatgcttcagacatggcctgtgcgttcaccaaggcctgntgcgtcnaagcttgctgncgatacaactctttctgacagggcagcg

SEQ ID NO: 88524 - protein, 176 aa, Zea mays
  misc_feature: Ceres CLONE 1575897
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDALWEFQPKKLGVGDVITGGDLYATVFENTLMQHHVALPPGSMGEK

SEQ ID NO: 88525 - DNA, 830 bp, Zea mays
  misc_feature: Ceres CLONE 1575898
  misc_feature: Encodes the peptide sequence at SEQ ID NO. 88526
ggagctccccgcggtggcggccgctctagaactagtggatcccccgggctgcaggaattcgtctcacccctagaaaaagtggcatatctgtaggcatctaccccgtcttcgtcgtccgttcctcactagctaccaagaggtcgccattattgccaacatagagtgtacgtggatgtctatatatatgcctacttgcacccatatggctagcgcggaggggagctcctccgattcttctctacccttcgcatgggagttcttgcattgcttcgttgcttctctagtttcttccttctacgtctttccagcatacgcatgcccctcgtccgccggttcacgaggcatctatcatctgatgatcagtagataataagcaatataatactgatctagaatcgagttgttgtactcttcgcagataggttcgttccttcacatagaagcctacagagtacagaccacacagtatcaggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtgaacggacgggttctacaacggcgaggtgaagacgcggaagatctcccactccgtggagctgacatccgaccagctcgtcatgcagaggagcgaccagctccgggagctctacgaggcccttcctgtcgggcgagggcgaaccggcgcgctgcgcctgcgccctgcgcggccggcctggctccttgtc

SEQ ID NO: 88526 - protein, 54 aa, Zea mays
  misc_feature: Ceres CLONE 1575898
  misc_feature: The sequence is a functional homolog of SEQ ID NO 116 in the 10/666,642 US patent application
MALSASRVQQAEELLQRPAERQLMRSQLAAAARSINWSYALFWSISDTQPGVLT

SEQ ID NO: 88527 - DNA, 1059 bp, Zea mays
  misc_feature: Ceres CLONE 1575899
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (106)..(106): n is a, c, t, g, unknown, or other
  misc_feature (108)..(108): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (418)..(418): n is a, c, t, g, unknown, or other
  misc_feature (419)..(419): n is a, c, t, g, unknown, or other
  misc_feature (443)..(443): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
nnnnnnnnnnnnnggggnnnnnnnnggggggggggggggggnnggggnnngggnncgnnngnnngnnggnnnnnnggnnnnnnnnnnngnnnnnnnngcggggggngngggnnnnnnnnnnnngnnnnnnnnnnnnnnnnnnnnnnnnnnnnncctcnnnnnnnnnnnnnaaaagctggaagctcaccgcggtggcggccgctctagaactagtggatcccccgggctgcaggaattcgtctcacccctagaaaagcgagctaggcgcctaggcgtagcgtagctctctccaagtctccatttcccttcccgaaccctcgcgccgccgcctactccagcctccagcgtgatctgagtcctgaccaagccctaaacgccaccgccctcgcaaatctcctttcccttcgatccatggccnngcgcgtcgccgcccccgcgccatncccgaagacggagacctacaccgacaccaagcgccgcgacgacgtgcgcggcggccacatcggccgctgcgcgcgccgttcccccgaagccctgggcgcaccctcgttggggccccccgggggcatggaaaaaaaagaatccccctccgggggaaccaggggctccggggaggggttttttttcccccaaagggaaggggggcccccattttttttttctccgcgatggggggggcttcccctccaaaacccccccccggggggggaaatttggtctcccccccaagaaaattttatcccgcgccttcccccacaagagaaaaaccccccccccccccggtgggggggaaaggggggggcccccccttattccgcgggggggggggggcgcccccccccgcggggggggagaaccccccccccctcctcgccgggggggggcaaaaaaagaggcccccccctccctccccccccggggggggggggattcccccccccacacaannnncgtgttgtgtggaaaaaaacccccctccaccccccttttttttctccaccccaggggggggggcgcggggtggaagaacaccccccccccccccggggggggggttcc

SEQ ID NO: 88528 - DNA, 890 bp, Zea mays
  misc_feature: Ceres CLONE 1575901
  misc_feature: Encodes the peptide sequence at SEQ ID NO. 88529
ctggagctccccgcggtggcggccgctctagaactagtggatcccccgggctgcaggaattcgtctcacccctagaaaaaagcacacactcgcacgcacgagaaggccggagaggcggcgcacccggagaggcaaggcaagcgatccctctccctccctccctcgtatccaggacaacagcccgtgcgatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgtcgtcgcgctcgtcgacgctgccacgggcccacgggtcacgttccaagaactctggcgcgccggtggaaggggcggcccaccgcggttcggccggcgccggccgctggttggttcccccagggggccaagaatcccgccctaatccctccccccccgagaacttcccggtcccaacttttccccgtttttgccccccccccctttctaaaaacccaatgggttccccttttggggggggccccgggtttcttttataaacaaaactgggggacaaaaaaccccgggtttttttaaaaaaaacaggcccccccgcccccgagaaaaaatattcccccccaaaaaaacaaggggggggtgccccaaaaaaaagcggggacgcccccccccttggttttgtttggcccctaattttaacccccaaccccccggggggaggaaacactccctcccctcccccccaaaaaaatgtttcccccctcgcggagccccctcggggggggcccccccggggggctccccggtgggaaatttccctcccgggggtggtcccg

SEQ ID NO: 88529 - protein, 93 aa, Zea mays
  misc_feature: Ceres CLONE 1575901
MAARPDARSGYCAATRTFRSKRADVPLPADADLDVVRFLASRRHAGVVALVDAATGPRVTFQELWRAGGRGGPPRFGRRRPLVGSPRGPRIPP

SEQ ID NO: 88530 - DNA, 925 bp, Zea mays
  misc_feature: Ceres CLONE 1575902
  misc_feature: Encodes the peptide sequence at SEQ ID NO. 88531
  misc_feature (829)..(829): n is a, c, t, g, unknown, or other
  misc_feature (877)..(877): n is a, c, t, g, unknown, or other
  misc_feature (898)..(898): n is a, c, t, g, unknown, or other
aagctggagctccccgcggtggcggccgctctagaactagtggatcccccgggctgcaggaattcgtctcacccctagaaaaacctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtcttgacaagaaggcaaccagcgtcggtgaagaagatgtcctcatctttgacccttggaggtggtaccntcgatgtctccctccttactattgaggaaggtatctttgaggtcaggncacagctggcgacacccatcntgggggtgagggacttgacacaggatg

SEQ ID NO: 88531 - protein, 218 aa, Zea mays
  misc_feature: Ceres CLONE 1575902
  misc_feature (9)..(219): Pfam Name: HSP70 Pfam Description: Hsp70 protein
  misc_feature (211)..(211): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEEDVLIFDPWRWYXRCLPPYY

SEQ ID NO: 88532 - DNA, 1055 bp, Zea mays
  misc_feature: Ceres CLONE 1575905
  misc_feature: Encodes the peptide sequence at SEQ ID NO. 88533
  misc_feature (45)..(45): n is a, c, t, g, unknown, or other
  misc_feature (53)..(53): n is a, c, t, g, unknown, or other
  misc_feature (59)..(59): n is a, c, t, g, unknown, or other
  misc_feature (60)..(60): n is a, c, t, g, unknown, or other
  misc_feature (1015)..(1015): n is a, c, t, g, unknown, or other
tttttctcccccctcctcttaccctccttctccagcccctattcntggattanaacacnntttcaaaactggagctccccgcggtggcggccgctctagaatagtggatcccccgggctgcaggaattcgtctcacccctagaaaaaatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggccccctgtggcgtgctctgcgccgcaacttcgtcgccgagatcgtgtccccgcaccgcgtcaagggcttctcctggatccgggagtgggccgtggacgcgcacttgcgccgcctctgcgccgagctcgcggcggacggtgccctgcgggtcatgggcaggctgcccgcctcaccctctgcagtatcctcatctggcatctgctttcgggcccaaagatccccgacgagctcttcccgggtaaatcgaggaaggtgctcaagggacgtgtttgatggatgaccatgccccaatctcccggaactttcttggcccctccttcaaaacaggtcctttcaagaaaacaagctcacctataggaccccggtcccctgtgggccggcctccaagattcaaactggcactccttggccgcctccttcccgcctccntcgcaaaggagattttctctccgccagaagagactccccc

SEQ ID NO: 88533 - protein, 217 aa, Zea mays
  misc_feature: Ceres CLONE 1575905
  misc_feature: SWISSPROT Homolog: EC 1.14.13.89 Isoflavone 2'-hydroxylase
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVGKCTVNSAPYGPLWRALRRNFVAEIVSPHRVKGFSWIREWAVDAHLRRLCAELAADGALRVMGRLPASPSAVSSSGICFRAQRSPTSSSRVNRGRCSRDVFDG

SEQ ID NO: 88534 - DNA, 834 bp, Zea mays
  misc_feature: Ceres CLONE 1575907
  misc_feature: Encodes the peptide sequence at SEQ ID NO. 88535
aaagctggagctccccgcggtggcggccgctctagaactagtggatcccccgggctgcaggaattcgtctcacccctagaaaaagcaagccacaaatatttgcaagcgcacaagccaagccaagcaaaaccctaagaaacccaccctccctccagtctcctcgacccccgccgccgccaccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggacggtgggtgggtccggacgggccgggagcaggggaagggctccttcaccttcctggagctcagcgacgggtcctgcgctgccacgcttcaggccatcgttgacgccgccgtgcacccgctagcgcgcctcaccgccaccggcacctccgtcctcgtcgagggcgtgatcaaggagccgcccgaggggaccaagcagaacgtcgagctgaaggtcagccgcgtgcttgaggtcggcgaggtcgatgccgccgtctacccgctgcccaaggggaaggtcaaactcacgctcgagaagctcagggacgtccgtcatctccgttcgcgcaccaacacgattggagcgggctgctaggaataaggcaccagtttagccttatggccttacaccggggttctttggattgagaaagggaattttctccttatggtaccttagcccccaattaaataacctatccaaggggggacgggggg

SEQ ID NO: 88535 - protein, 161 aa, Zea mays
  misc_feature: Ceres CLONE 1575907
  misc_feature (43)..(122): Pfam Name: tRNA_anti Pfam Description: OB-fold nucleic acid binding domain
  misc_feature: SWISSPROT Homolog: EC 6.1.1.22 Asparagine--tRNA ligase
MAADAAAAAMSATSLCDDLEPATVRTRIRDVLAAGAARAGDRVVDGGWVRTGREQGKGSFTFLELSDGSCAATLQAIVDAAVHPLARLTATGTSVLVEGVIKEPPEGTKQNVELKVSRVLEVGEVDAAVYPLPKGKVKLTLEKLRDVRHLRSRTNTIGAGC

SEQ ID NO: 88536 - DNA, 1226 bp, Zea mays
  misc_feature: Ceres CLONE 1575909
  misc_feature: Translation starting site: 238
  misc_feature: SWISSPROT Homolog: EC 2.1.1.14 5-methyltetrahydropteroyltriglutamate--homocysteine S-methyltransferase
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
ttttttttcccccggctgtgtaagtgtactccacacgctttgtcaattttattaaaaannnnnaaaaactggagctccccgcggtggcggccgctctagaatagtggatcccccgggctgcaggaattcgtctcacccctagaaaaatgctcgggatcaccacccacatcttagttcaccccggggtcgtcctcctccccctgtagctactctgccgctccacgttccaaaggaaagatggcgtcccatattgttggatacgctcggatgggccccaagagagagctcaagcttgccttggagtctttctgggatgggaagagcagcggcgatgatttatacaaagttgcctctgacctcaggtctagcatctagaagcaaatgtcagaagctgtcgatcctgtacattcccagcaacaccttctcgtactatgaccccgtccttgataccaccgccatgcttggtgccccccggaagcgctactcttggattaggacgcgagattggcttgagcacataatgtcgcattggccaagaggaaagggcctctggcacctagctatggatacggcctaagtggctgtgatacagattacccactttaagaagcccctgcacctgggccccaagcacccaagcgtcacaatagcgcgtttcttataaaaggctcgtcttctcgatttccaaggtggcgggcaaaaccgcttctgtgtgattgggccacctgtttacccaaagtgcttattttcgggaaccaaaagggccctctacattgtgcttcactccacctaaaggcgcctggcacatagggttgaggtggcgaagaaaacacacttttataataccagtcgcccgctgtctggctgcttcatgtggggcggcctcttttcctattccccaatttctatgctaatcgaaggtttgttcacgcactcaatgcgtgtaatgggtccccctatttccggctttccaatggcaatttccgagggcggagtaggcacggccgccccagtttgtgaagacacaccattttgacgggtcttcactgaaattggtacacgaatctgctccactacgcaatctttcgctttaacacagtgagactcttaacttttgcccggaaactcccacgcgacctatttaaataatccaaaatatatctccgcatttcgcggacttggatcctctctgcaggaactgttgtaggacccatggttccttgtga

SEQ ID NO: 88537 - DNA, 819 bp, Zea mays
  misc_feature: Ceres CLONE 1575916
  misc_feature: Translation starting site: 332
  misc_feature: SWISSPROT Homolog: EC 1.14.13.11 Trans-cinnamate 4-monooxygenase
ccccgcggtggcggccgctctagaactagtggatcccccgggctgcaggaattcgtctcacccctagaaaaagtgccaccaatgaccaaaaccttctccggctctccagtccctccacgacggctctacaccccctacctaccgcatgtccgtcaattttaccgccaactccccagtccccataccgccgtttctcctatatatgcgcacggacatgtccgttgagatctccaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccggatggggcagcgcaacctggtggtggtctcgtcgccgccgctggcgcgggaggtgctccacacgcagggcgtggagttcggctcccgcatctgcaacgtggtcttcgacatcttcacggacaaggggcaggacatggtggttcaccgtgtacggcgaccactggcgcaagatgcggcgcatcatggacgtgcccttcttccccaacaaggtcgtgcaccagtaccgccacggctgggaagccaaaggcccccgccgtcgttaaagaagggggc

SEQ ID NO: 88538 - DNA, 1283 bp, Zea mays
  misc_feature: Ceres CLONE 1575921
  misc_feature: Encodes the peptide sequence at SEQ ID NO. 88539
  misc_feature (13)..(13): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
caaaaagttcaanacccaccaacacaaaacaaaaaaaaacaccaaaaaaataaaaaacnnnccnannnnnacaaactggaactccccgcggtggcggccgctctagaactagtggatcccccgggctgcaggaattcgtctcacccctagaaaaaatgaatactatcgtcaccgccaatggcggcggctccaccaacgggtgaagggaagcgtcctcggctgctatccgtcgtggtagtctatccatgttcatatgatcgagcccgtgcctgtgttgagttcggttctaacacttgccgccgatttggaaagccaaggggtcggcgccgacgccggcgccttccctgttctccggctcggatttacaggaagtagtgcggattgcaggactcctcgacgggtttctggaggaggttcaagacttgtctctgaccaataccgcacctctgccatgagtggctgagcttgggatcgtggcacccccccaagacatggataaaacttgcggttacctcctcacgtactgtcccgcgaaggtgggggcgtggaattttgggtggatttctggaactgacagaaattgtgcggcccttgtgaagcttcccaaattgattttcttggggggcgccttttttaaaaaggaacattggaaggggccccttcccaaaaagggaagatttccttgaaaacaccgttccccaaagaaacgcttccaaggagaaaagtttcacccaaatggaccctcgggtgttctataaaaagcgcgattcctctattataacaagtggtgagcacaagagggtggtcccataatatcttcggggaatgtgcgagataaaaaaaaataattttttgttctataaaacgaagcgttgttgcatatctaatgtgtccgcctcgctgaaaggaggattcttgcacccacctaagcgtgtttataaagataagcatggtgcggtttctcttctgccgagaagaagactctcttcaagagataatctccaacaaggggcgtgggtgttgtctctttaaagagaaatatattctccgacgatttttgtaagaaatatctttgtttctcacaatatctcctctctcggagaaaagaatatatttgttttcttctcgtgtagagagaaagaacagtctctttattaacaaattttataagagtggtgagaagaggctgcacaaatacactaagtgtgggagataatagtgagagttgtctatatagaaagaatatttgtggggagaaacaaaagagagatagcccaatcttt

SEQ ID NO: 88539 - protein, 69 aa, Zea mays
  misc_feature: Ceres CLONE 1575921
MIEPVPVLSSVLTLAADLESQGVGADAGAFPVLRLGFTGSSADCRTPRRVSGGGSRLVSDQYRTSAMSG

SEQ ID NO: 88540 - DNA, 946 bp, Zea mays
  misc_feature: Ceres CLONE 1575922
  misc_feature: Encodes the peptide sequence at SEQ ID NO. 88541
  misc_feature (658)..(658): n is a, c, t, g, unknown, or other
  misc_feature (937)..(937): n is a, c, t, g, unknown, or other
aagctggagctcaccgcggtggcggccgctctagaactagtggatcccccgggctgcaggaattcgtctcacccctagaaaaagcgccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggaacaccgggatcgggataaggatgacgggaaggagaaggagaggagccgcgatagccgcgggaaggacagagacagggaagggagagaacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgctttccagctatctctgaangcagacgaaagagatgtttatgagttcttctcaagggctgggaaggttcgtgatgttcgtcttatcatggacccgaaactcagacgttctaaaagagttgggattacacactgaaattttatagtttgctctacatgcctgggattatcggcaatttacaagttctaggcaataaaagggggcacccaagaaacaagttcgaaacctcctacaatttttgatcaaaatgcctgaagtgtttctgtgaaaaaatgaaatgtcctaactatggaggacgcnatttatgga

SEQ ID NO: 88541 - protein, 214 aa, Zea mays
  misc_feature: Ceres CLONE 1575922
  misc_feature (177)..(177): Xaa is any aa, unknown, or other
MEFDEYEYLEKAVEPAPPPANGSGSGEKDRGSRRREGDEGRISKRSRSGEDRERGRHRSVREHRDRDKDDGKEKERSRDSRGKDRDREGREREKERGDRHRPREREVERERRSLSRSERRRIEEEEMVRELEMERERSERHHYRDRDVRRRKDDGAEPEVDPERDQRTVFAFQLSLXADERDVYEFFSRAGKVRDVRLIMDPKLRRSKRVGITH

SEQ ID NO: 88542 - DNA, 838 bp, Zea mays
  misc_feature: Ceres CLONE 1575923
  misc_feature: Encodes the peptide sequence at SEQ ID NO. 88543
  misc_feature (838)..(838): n is a, c, t, g, unknown, or other
tggcggccgctctagaactagtggatcccccgggctgcaggaattcgtctcacccctagaaaaagtcccggatcaaccacctcctcggtccgcaaccacaaccacacccgccctcccgctcgccgcagccagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccggactcctccatactctccccctacatcgccgcgccggacgacatcgcgcgagcctttggggcccccgcctccgagctccggccgttccccagggccgaccccagccttgggctatgttgcacgggcaccgaccagccgctggggggagtcgcggaactgggcgcaactgccgtggtccaattcggcttccacccacccccgcgaagcggggccctgttgggaaaccccctttcccccaaaccgtttccccttttggaacccttcccaagggttaaggaactcccgtgggccaaggcctccatccaataaggggccggaacagcaggggtttttttctgggggggaggaaaaacgcctttcccccgagggggccttaaaaaaaaaagtgaggagggttgtgtcccggccaaan

SEQ ID NO: 88543 - protein, 53 aa, Zea mays
  misc_feature: Ceres CLONE 1575923
MLHGHRPAAGGSRGTGRNCRGPIRLPPTPAKRGPVGKPPFPQTVSPFGTLPKG

SEQ ID NO: 88544 - DNA, 828 bp, Zea mays
  misc_feature: Ceres CLONE 1575927
  misc_feature: Encodes the peptide sequence at SEQ ID NO. 88545
ctccccgcggtggcggccgctctagaactagtggatcccccgggctgcaggaattcgtctcacccctagaaaaaaccaaccaaacagaggaaaaggaggggaggaagaagcggaggagagagaaaccctaatcgagatgggcaagcttctctgcgacccctccgccgccgccgtcgccgaggccctgccgccgtccccagcccccgctccgcctccgccgctcctcgcttggtcctccccggccccggcctcctcccccgaggcctccatctcgcccacaggctgggacgcggtctgggcgctcgaggaccagcagcgccgccgcctccaccggatctgggagcggggcgtcgcgtggaaaccctcctcgccgggcgccggcgaggccgcgttgccgcccgtggtcttccgcctcgaccacggcggggaggtcgacgccgatggcaactgcctcttcaccgccgcgcggacggcagccgctgccaaggccgacgcgcgcgagctgaggcaccgcgcagtgcgccgattcgccgaggtctacgccgccgctggggaggacgacaagaacgccgtcgacgccgccgtgaggcacctctacgcgccggatctcaaggccgggtggggcgtccatgtcgtgcaggagatcaaggcgctcgtgcccaaggcccagcgccacgcgctcgactccgccatccaggagctcgtcgatctcggtatccaaaggtaccgtgctcgcggatctgcccttgctcgcagctctagctcaaatcttttgattttctcgccacttcaagatctaaaagccttgtcattttttccgtatgcctt

SEQ ID NO: 88545 - protein, 230 aa, Zea mays
  misc_feature: Ceres CLONE 1575927
MGKLLCDPSAAAVAEALPPSPAPAPPPPLLAWSSPAPASSPEASISPTGWDAVWALEDQQRRRLHRIWERGVAWKPSSPGAGEAALPPVVFRLDHGGEVDADGNCLFTAARTAAAAKADARELRHRAVRRFAEVYAAAGEDDKNAVDAAVRHLYAPDLKAGWGVHVVQEIKALVPKAQRHALDSAIQELVDLGIQRYRARGSALARSSSSNLLIFSPLQDLKALSFFPYA

SEQ ID NO: 88546 - DNA, 763 bp, Zea mays
  misc_feature: Ceres CLONE 1575928
  misc_feature: Encodes the peptide sequence at SEQ ID NO. 88547
  misc_feature (543)..(543): n is a, c, t, g, unknown, or other
  misc_feature (581)..(581): n is a, c, t, g, unknown, or other
  misc_feature (587)..(587): n is a, c, t, g, unknown, or other
  misc_feature (590)..(590): n is a, c, t, g, unknown, or other
  misc_feature (618)..(618): n is a, c, t, g, unknown, or other
  misc_feature (619)..(619): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (628)..(628): n is a, c, t, g, unknown, or other
  misc_feature (656)..(656): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (687)..(687): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (737)..(737): n is a, c, t, g, unknown, or other
  misc_feature (738)..(738): n is a, c, t, g, unknown, or other
ggagctccccgcggtggcggccgctctagaactagtggatcccccgggctgcaggaattcgtctcacccctagaaaaaactcaccttcacaaacattgcaaaagcactcctctcttcgtcctccccctccctcctccatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtcccgccccccagcaacccccgggggtttttttttcttggggggggaagccgctctttttttgaaaaaaaaaaaaaaaaaacatttttctctcaaaggccccgcgccccccccactttcaccccaagacaagncgcccccccctccttttgggggggtggtgcgggagcanatcttngcncttcctcctttccttcccccctttcggnnannnnaaantaagaaaaaaaaaaaatatacccccctntaggatataanannnntaacggagcgggggngggcggggcggcccccctcccgcccnnntnnntgtgtggccggtccgcgnnttttcgcttggacacagacaagaaa

SEQ ID NO: 88547 - protein, 111 aa, Zea mays
  misc_feature: Ceres CLONE 1575928
  misc_feature (87)..(87): Xaa is any aa, unknown, or other
  misc_feature (100)..(100): Xaa is any aa, unknown, or other
  misc_feature (102)..(102): Xaa is any aa, unknown, or other
  misc_feature (103)..(103): Xaa is any aa, unknown, or other
MGGKDCGNHGEDDLRRSCRRLLAILLVLALIVGVIALIIYLVVPPPSNPRGFFFLGGGSRSFFEKKKKKTFFSQRPRAPPTFTPRQXAPPSFWGGGAGAXLXXSSFPSPLS

SEQ ID NO: 88548 - DNA, 938 bp, Zea mays
  misc_feature: Ceres CLONE 1575932
  misc_feature (301)..(301): n is a, c, t, g, unknown, or other
  misc_feature (322)..(322): n is a, c, t, g, unknown, or other
  misc_feature (888)..(888): n is a, c, t, g, unknown, or other
gagctccccgcggtggcggccgctctagactagtggatcccccgggctgcaggaattcgtctcacccctagaaaagctgcttcgctggctttcggcaacgccctttaccacatctgaatctcacccacccacccacccccgcgtcccccacctcatggcgccggcgatggggctgaagcggcctgcggcgggagcaggggcggcagcagcgcagaccgtcacgctgtccgcgcctgcccgtgcggaacgcgtgcgcaccgccgtagggagggcgaggccacggcgaaggctaccgccccgncgccagggtcctgcaacgggngcaatgcggccgaaattccttggaatggggtgctttgcccttgagaaggtcaacggggaggcggggaaccttttttggctcaaacccccccgggccccccggttaaggcccaaggaaaggggggttccttttggggggggccctttaaggggggtccccccttccaatccccccaaacccgcccccttaaggaaaaaaaattttcccttttttaaaaaaaaatatattttttggccccccaagaggtttttcccaaaaaagggggtgcccccccccctcctattgtgttcccctcacaaccaacaccggggggggagaacatttttaaacacccttttttttttttggggaggaaaaaaaggggggggggtttttttataaaaaaggaggcgtttgctcttcaccccttttgtgtgggggaggcccccccaacaaaaaggggggtggcccctcggggggggggggggggcgtcgcaccccgcgggggttctccgggaaagggggcgcgggggcgccctttttttaaaaaaaaaatatttttttcctccccccccgggggagaaaantatattttttttttttttggggggggcgccccctcttttttttgttggtg

SEQ ID NO: 88549 - DNA, 962 bp, Zea mays
  misc_feature: Ceres CLONE 1575935
  misc_feature (820)..(820): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
aaagctggagctccccgcggtggcggccgctctagaactagtggatcccccgggctgcaggaattcgtctcacccctagaaaaaaaaaaaattcgtcaggctcaatggaattcttttcacgaggaccagtttggaaacattcggggagctgttttcttcagttagcaatgatttgcagattcttctttcttctggtcttgaagaggaccttaatttcggttctgatgctgcagaaaatgcattggctgctgttaggcttactgtcatccttatattcacagtgcacaatgtaaataaagaacctgataggcagtcttatgctgaaattgtgcaacgcagagtactgctccaaagtgcgtttacggctgcttttgattttgttggacgaattctcagaaggtgttcagagctccatgatattgcatcaagcttctatctgccagccattttggtctatattgaatggctggcgtcccatccagagttggctgttgattcagagatggaggaaaagcatgcaagatgccaggtctttcttctggagccaatgcatctcatttatgaataagttgatccttaccaaccttgcatctgtgaatgatgatgatgacgaggcttgcttttctaatatgagcatttatgacgagggtgaaactggcaacaggtttgccctttgggaagatcttgaattgagatgttttctgcccttgcttcctgcacataccattttggatttctcgagcaacacacttttcgaagcactgaggaaactaagcacggctcagcgcatttgtgctgcaggaagtcactgacttacttngttcacatgatcagttgagatcttatctgatcatccatcgaggagtttgttatgaccagtaccctcctgtttcgtaaactacaccctccttcccgatctcctgatgccttgtgttgnnnnnnnnnnnnnnnnnnnnnnnnnt

SEQ ID NO: 88550 - DNA, 2450 bp, Zea mays
  misc_feature: Ceres CLONE 1575937
  misc_feature: Encodes the peptide sequence at SEQ ID NO. 88551
aaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgacaacctgatcgggacgctgacggtgcgcgagacgatcggctactcggcgctgctgcggctgccggacaagatgccgcgggaggacaagcgcgcgctggtggagggcaccatcgtcgagatggggctgcaggactgcgccgacaccgtcatcggcaactggcacctccgcggggtcagcggcggcgagaagcgccgcgtcagcatcgcgctcgagctactcatgcgcccgcgcctcctcttcctcgacgagcccaccagcggcctcgacagctcgtctgcgttcttcgtgacgcagacgctgcggggcctggcgagggacggcaggacggtgattgcttccatccaccagcccagcagcgaggtgttcgagctcttcgacatgctcttcctgctatccgggggcaagaccgtctacttcggacaagcatcgcaagcatgcgagttctttgctcaagccggtttcccttgcccggctctgcggaatccgtccgaccatttcctgaggtgcgtcaactcggacttcgacaaggtgaaggccacccttaaaggatcgatgaaagcaagggtcgagaggtccgacgatccacttgacaggatgaccacatcggaggccatcaggaagttggttgcatcctacagcaggtcccagtactactacgccgcaagggagaaagtaaatgacatctcgcgaatgaaaggaaccgtgctggattccggtggcagccaggccagcttcctgatgcaggcctgcaccctgaccaagcgctccttcatcaacatgtcgcgggactttgggtactactggctcaggctcctcatctacctcctcgtcaccgtttgcatcggcacgatctacctggacgtcggcaccaaatacacatccatcctggccagggctgcctgttccgcgttcgtctttgggttcgttacgttcatgtccattggaggattcccttcgttcgttgaagaaatgaaggtcttccagcgggaacggctgaacgggcactacggtgtcgcggcgtttgtcatcagcaacaccatctcggcaacgccgttcctgattctgatatgcttcttgtcgggaaccatatgctacttcatggtgcgcctccatcctggcttcgagcactacatcttcttcgtcttgaacctgtacgccagcgttacggtggtcgagagcttgatgatggcgattgccagtgtcattcccaatttcctcatgggtatcatcataggggccgggattcagggaatattcatgctggtctctggctacttcagacttccatacgacatcccgaagcccttttggagataccccatgcagtacatcagcttccactactgggcactgcagggccagtgccagaacgacatgaagggcctcgtgttcgacaaccagtacccggaccaacccaagatccccggggacttcatcctcaagtacatcttccagatcaacgtggaccgttccaagtggatcgacctgtcggtcattttcagcatgatcttcatctaccgcatcctcttcttcctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaggtcgtgcttgttcttttgggtagcggaaaaaaaatagggtgtttctcccccccggctcttggtgttatattgtatatttaagatcaggggataaaaaaactggtatcacacgttttggaaaaaagaaaaaaaaaaaaaaaaa

SEQ ID NO: 88551 - protein, 721 aa, Zea mays
  misc_feature: Ceres CLONE 1575937
  misc_feature (104)..(293): Pfam Name: ABC_tran Pfam Description: ABC transporter
  misc_feature (406)..(618): Pfam Name: ABC2_membrane Pfam Description: ABC-2 type transporter
  misc_feature: SWISSPROT Homolog: EC 3.6.3.28 Phosphonate-transporting ATPase
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNGRKAKLSFGAAAYVTQDDNLIGTLTVRETIGYSALLRLPDKMPREDKRALVEGTIVEMGLQDCADTVIGNWHLRGVSGGEKRRVSIALELLMRPRLLFLDEPTSGLDSSSAFFVTQTLRGLARDGRTVIASIHQPSSEVFELFDMLFLLSGGKTVYFGQASQACEFFAQAGFPCPALRNPSDHFLRCVNSDFDKVKATLKGSMKARVERSDDPLDRMTTSEAIRKLVASYSRSQYYYAAREKVNDISRMKGTVLDSGGSQASFLMQACTLTKRSFINMSRDFGYYWLRLLIYLLVTVCIGTIYLDVGTKYTSILARAACSAFVFGFVTFMSIGGFPSFVEEMKVFQRERLNGHYGVAAFVISNTISATPFLILICFLSGTICYFMVRLHPGFEHYIFFVLNLYASVTVVESLMMAIASVIPNFLMGIIIGAGIQGIFMLVSGYFRLPYDIPKPFWRYPMQYISFHYWALQGQCQNDMKGLVFDNQYPDQPKIPGDFILKYIFQINVDRSKWIDLSVIFSMIFIYRILFFLMIKINEDALPWIRGHIARKRMQKKGPTPTMGKTPSLRGYVVDPELGSNEG

SEQ ID NO: 88552 - DNA, 955 bp, Zea mays
  misc_feature: Ceres CLONE 1575940
  misc_feature: Encodes the peptide sequence at SEQ ID NO. 88553
ggagctccccgcggtggcggccgctctagaactagtggatcccccgggctgcaggaattcgtctcacccctagaaaaaacaccaacccagccatggccaagggagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagagggagggggagaaccccttgatgacacccctgccctacatgatcatcttcggcatgtccacccccttcgtcatcctcgccatcgccttcgccaatgggtggatcaaggtccctggtgcgatgaccgtaacgcgatcagccagcccgggaacatagatgccggaatccttcgccctggctttttctctccaggggggggtgcctggcgaactttggtaccccttcccctcttctgggggaccaaagagttccttggcgggggggagacaaaaaattggcttggaattctcgcgtgggggttatggttaacccccccaaaaactgggttttcactctttttggggcagaacaacctttcgatatcctgcccactccccgtccaaaaataaaaaacatagcgaccccaaaaccagaggtgtggaggggggaaaatccctcccctctaattgttgggagggtgggaccctagatcttcgccagcccgggggtgtggtgcgggaagactcccctattctggaaatacaacggcgcgccctcgaggcatcaagaataggtgtgtttgggcccgccctgaggtcgcccctttcaacaaaacgaggggaggatattgaagatagagtgtgccg

SEQ ID NO: 88553 - protein, 130 aa, Zea mays
  misc_feature: Ceres CLONE 1575940
MAKGAPPLLAAGSRTAITAQQPSSRKGAAGTGLFCSRAIVSKRTRVTAKLGDGELKPAGKRKFITKEEEPEQYWQTAGEREGENPLMTPLPYMIIFGMSTPFVILAIAFANGWIKVPGAMTVTRSASPGT

SEQ ID NO: 88554 - DNA, 843 bp, Zea mays
  misc_feature: Ceres CLONE 1575941
  misc_feature: Translation starting site: 188
  misc_feature: SWISSPROT Homolog: EC 1.4.1.2 Glutamate dehydrogenase
  misc_feature (574)..(574): n is a, c, t, g, unknown, or other
  misc_feature (626)..(626): n is a, c, t, g, unknown, or other
  misc_feature (698)..(698): n is a, c, t, g, unknown, or other
ctggagctccccgcggtggcggccgctctagaactagtggatcccccgggctgcaggaattcgtctcacccctagaaaaaaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatncagatgcgtgagatcgctgaagcttaccttggcagcacgatcaagaatgctngtgtcacggtccctgcctactttcacgactcacagaggcaggccacgaaggatgctgggggtgattgctggncctcaatgtgctgcgtatcatcaatgaggcaaccgctgctgctattgcctatggtcttgacaagaagcaaccagcgtcctgtagaagaatgtcctcatctttgacttgggaggggggacctccgaagtctccctcctaccattgg

SEQ ID NO: 88555 - DNA, 853 bp, Zea mays
  misc_feature: Ceres CLONE 1575943
  misc_feature: Encodes the peptide sequence at SEQ ID NO. 88556
  misc_feature (605)..(605): n is a, c, t, g, unknown, or other
ctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttatcaacaacctcggtaccatcgccaggtccgggacgaaggagttcatggaagcccttgctgccggcgctgatgtgtccatgattggccagttcggcgtcggtttctactctgcctacctcgtcgccgataggagtgtcgtgaccacaagcacaacgatgacgagcagtacgtgtgggagtcccnagcgggcgggtcgttcactgttactcgtgacacgtcaggggagcagcttggcaggggcactaagatcaccctggttcttaaggacgatcagctggagtaccttgaggagcgtcccctcaaaggatctgggtcaagaggcccctcctgagttcatcggctacccccatctcccctggtggactgaaaaagaccaccggaggaaggaaattttctggaccgacgaaagacggaggaaaaaggaagaaagc

SEQ ID NO: 88556 - protein, 235 aa, Zea mays
  misc_feature: Ceres CLONE 1575943
  misc_feature (28)..(154): Pfam Name: HATPase_c Pfam Description: Histidine kinase-, DNA gyrase B-, and HSP90-like ATPase
  misc_feature (153)..(153): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLINNLGTIARSGTKEFMEALAAGADVSMIGQFGVGFYSAYLVADRSVVTTSTTMTSSTCGSPXRAGRSLLLVTRQGSSLAGALRSPWFLRTISWSTLRSVPSKDLGQEAPPEFIGYPHLPWWTEKDHRRKEIFWTDERRRKKEES

SEQ ID NO: 88557 - DNA, 954 bp, Zea mays
  misc_feature: Ceres CLONE 1575944
  misc_feature: Encodes the peptide sequence at SEQ ID NO. 88558
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (761)..(761): n is a, c, t, g, unknown, or other
  misc_feature (762)..(762): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (887)..(887): n is a, c, t, g, unknown, or other
ctggagctccccgcggtggcggccgctctagaactagtggatcccccgggctgcaggaattcgtctcacccctagaaaaaagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgaacgtcccgcgcgctgcacgagtgatgaagccaggggagaaataaaataaagccgctgtattgccaggagcagcatgcattatttatcgatctatatatatactgtactgtagtactctattatatatgtatatatgtgtggcctgcagtgcgagttgcttcgatccacctacttgttcacacagtttaannnnnnnnanngnnnnnnannnnnngnnnnnnaaannnaatggacgccaacaaagccctaacctgcacaacctttccccctcgcagcaaagcgaaacgatctcctcgtcgtcgcctcgccgtctcctcgcccgtgnctgcgatcccgatcatggagggcgacgtaccacctcgaccggcgttagaatccctcctgacgtgaaa

SEQ ID NO: 88558 - protein, 123 aa, Zea mays; identical to SEQ ID NO: 88165
  misc_feature: Ceres CLONE 1575944
  misc_feature (34)..(119): Pfam Name: Tryp_alpha_amyl Pfam Description: Protease inhibitor/seed storage/LTP family

SEQ ID NO: 88559 - DNA, 967 bp, Zea mays
  misc_feature: Ceres CLONE 1575945
  misc_feature: Encodes the peptide sequence at SEQ ID NO. 88560
  misc_feature (413)..(413): n is a, c, t, g, unknown, or other
aagctggagctcaccgcggtggcggccgctctagaactagtggatcccccgggctgcaggaattcgtctcacccctagaaaaaaaaccctagtcctctgttacttctcccgccgccgccaatcccctcccgttctccgccaccggcaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgcccacgaccagggtaaccgcaccacaccctcgtacgtcgccttcaccgactccgagcgcctcatctgagatgccgccaagaaccaggtcgccatgaaccccatcaatacccggcgcccccccccancagtctcattggcaggaggttttagtgatgcctctgtccagaggtgatatttaggctgtggccccatcaaggtccatttcttggggccctgttgagaagcccaattgatagtttgttccagcacaaggggggagggagaaaaacaagtttggcagcccgaaaaagatctccctccatggggttcttcctcacagaatgcggtgaggatccccgtgaagccttacccttgggcgggcccgcattcaagaaaggccgggttgtccacgggtcccctggcctacattcaacggaattctccaaagggccgggccccccaaaggattcttgggggggggaataccctgggcctccaagggggcttgccgaaccccctaatgaagcccaacccgcgccctggtatttggcgtgatggtctttgaacaagaagggaaacccagcctttggggggagaaaaaagtccccccatcctttgaccccttggggagggggaccccttccaaggtcccccccccccaacttttgggagaaggggtttctttttaggttaccgcccc

SEQ ID NO: 88560 - protein, 54 aa, Zea mays
  misc_feature: Ceres CLONE 1575945
MAGKGDGPAIGIDLGTTYSCVGVWQHDRVEIIAHDQGNRTTPSYVAFTDSERLI

SEQ ID NO: 88561 - DNA, 798 bp, Zea mays
  misc_feature: Ceres CLONE 1575947
ctggagctccccgcggtggcggccgctctagaactagtggatcccccgggctgcaggaattcgtctcacccctagaaaaaagccgaccacgcgagaactcctcctacattgataaacccaaccaatggtgaaccttcccttctctctgacatgctcctgctcgtacccgcgttcgcaatcccaacgatggggtcgagaccccagtgaataaaccctaccccgcgacgaaactagcttggtggcttaaatgcctgcaacagaccgcaagtccacgggcggctgacaatcctgctacccaaacgactgatgagacgaaagctgccctggactctaactcatgccaccatctgacattataagaaaccacctagcaactacgcaccatcctagaaacaattactggatagcaagaggaacgactgaagctcacaacgttccctcttacaccatggcgtcggtgactgcatcgaggactataagccatattggagtgatgaatgtgactactctccaaacatcaccgacgatctcaaataccagcagcttcaaaatagtgtgtcgcttacactgactaggaatggttgcagcatcgtcccgggcatagcacacaggcatgaaacactgcggtgaccctcccgcatggagctatcagtggctagagtttaaccatgatagcgacagggatgctcactctgcaaggacgactcgggatctcagccagcagattttatgagcatctacgaaatatctacccatcgtacataagcatcatcgtccattctataaagggatcctgct

SEQ ID NO: 88562 - DNA, 938 bp, Zea mays
  misc_feature: Ceres CLONE 1575949
  misc_feature: Encodes the peptide sequence at SEQ ID NO. 88563
  misc_feature (764)..(764): n is a, c, t, g, unknown, or other
  misc_feature (767)..(767): n is a, c, t, g, unknown, or other
  misc_feature (912)..(912): n is a, c, t, g, unknown, or other
aagctggagctccccgcggtggcggccgctctagaactagtggatcccccgggctgcaggaattcgtctcacccctagaaaaattccccatctccggataaaagataaggagtgtctctcctctctttcagctaagtccctgccccctctctttttcttacattcaggtcctcgcagctcctctcttttttcttgtttctttctttcgatctgcgagccgtccaggtccagtactctcctttccgtgaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccacctgctgatccttcgccgtctctctctctctctctctctctctctctcttagatagtcttttgaatccatctctagggctcttgtttctccccatcttccccccacccaaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaaacancancggctggaagaactggtggcggaggtggcccgcctgcaggcggagaacgcggcgacgcaggcccgcaccgcggcgcttgaacgcgacttgggcagggtgaacggcgacacgcggtgctgcgcgccgccacgcccaagctgccggncgcctgcattccctggccggcgtccc

SEQ ID NO: 88563 - protein, 97 aa, Zea mays
  misc_feature: Ceres CLONE 1575949
  misc_feature (15)..(69): Pfam Name: bZIP_2 Pfam Description: Basic region leucine zipper
  misc_feature (39)..(39): Xaa is any aa, unknown, or other
  misc_feature (40)..(40): Xaa is any aa, unknown, or other
  misc_feature (89)..(89): Xaa is any aa, unknown, or other
MSSSRRSSSPDSNDTTDERKRKRMLSNRESARRSRARKXXRLEELVAEVARLQAENAATQARTAALERDLGRVNGDTRCCAPPRPSCRXPAFPGRRP

SEQ ID NO: 88564 - DNA, 848 bp, Zea mays
  misc_feature: Ceres CLONE 1575952
  misc_feature: Encodes the peptide sequence at SEQ ID NO. 88565
  misc_feature (747)..(747): n is a, c, t, g, unknown, or other
gagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctaccccttggacgtatcattaatggtatcggtgagccgattgatgagaagggtgatataacgacaaaccactttcctccctatccatcgtgaaggcccctgcttnccttgagcaggccactgagcagcaaaatcttggtactgggatcaaggtcggtggatcttcttgcaccctaccaaagaggtggaaaaatggttctattcggg

SEQ ID NO: 88565 - protein, 167 aa, Zea mays
  misc_feature: Ceres CLONE 1575952
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATPWTYH

SEQ ID NO: 88566 - DNA, 921 bp, Zea mays
  misc_feature: Ceres CLONE 1575953
  misc_feature: Encodes the peptide sequence at SEQ ID NO. 88567
  misc_feature (703)..(703): n is a, c, t, g, unknown, or other
  misc_feature (708)..(708): n is a, c, t, g, unknown, or other
  misc_feature (711)..(711): n is a, c, t, g, unknown, or other
  misc_feature (712)..(712): n is a, c, t, g, unknown, or other
  misc_feature (775)..(775): n is a, c, t, g, unknown, or other
  misc_feature (877)..(877): n is a, c, t, g, unknown, or other
  misc_feature (880)..(880): n is a, c, t, g, unknown, or other
  misc_feature (917)..(917): n is a, c, t, g, unknown, or other
  misc_feature (921)..(921): n is a, c, t, g, unknown, or other
ctggagctccccgcggtggcggccgctctagaactagtggatcccccgggctgcaggaattcgtctcacccctagaaaaaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgaccgccccttacagggatttcttctggtggcaagggaagtggctagccaccaagttattgataccaagcccgcccttgagaaaccatcagattactcccttgtttggaccagtgctgacgcaaatgaagatgacaatagcgaatgtggttgcatctggctgccatgtccaccgaatgggtataaagcccttggctatgtggttactaaaggaccaaagaagccatcactggaagcagttcggtgtgtgcgagatgacctaacggacacgcgcgaaaatttccattcaattgcaaatatggacaacgcatgccagatttggaagacaaggccttgccaccnaggantgnngagggcgtggtataccggtcggtacattctcctgcgaaaccgattcacagatagcgatgaatncagcactccctgccctgaaatgtcgactcaaatctggggtgcatgccctatctggagcagatcaatgctctgatcagcactacgggcctactgttttctcanccngcagagacgtacttaccgtcatcagtttcttgggtcnttgn

SEQ ID NO: 88567 - protein, 250 aa, Zea mays
  misc_feature: Ceres CLONE 1575953
  misc_feature (20)..(249): Pfam Name: DUF946 Pfam Description: Plant protein of unknown function (DUF946)
  misc_feature (203)..(203): Xaa is any aa, unknown, or other
  misc_feature (205)..(205): Xaa is any aa, unknown, or other
  misc_feature (206)..(206): Xaa is any aa, unknown, or other
  misc_feature (227)..(227): Xaa is any aa, unknown, or other
MGGWNWLFCGRSKAGGGELRPPEPFQLPAPLPEWPQGGDFAKGTICIGEVDVTSITKFRSIWTCSDATFYEPEGIPDGFHCLGHYAQQNDRPLQGFLLVAREVASHQVIDTKPALEKPSDYSLVWTSADANEDDNSECGCIWLPCPPNGYKALGYVVTKGPKKPSLEAVRCVRDDLTDTRENFHSIANMDNACQIWKTRPCHXGXXRAWYTGRYILLRNRFTDSDEXSTPCPEMSTQIWGACPIWSRSML

SEQ ID NO: 88568 - DNA, 876 bp, Zea mays
  misc_feature: Ceres CLONE 1575954
  misc_feature: Encodes the peptide sequence at SEQ ID NO. 88569
tccccgcggtggcggccgctctagaactagtggatcccccgggctgcaggaattcgtctcacccctagaaaaaaaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaagaccgcccgtccccgcctgccgaggaggacgccaagcgctacgggctcaacgggaacgggagcgggctcggatacgacgatgccgccgtccaagcgtacctcggaagcaacggtaacggtagcgccagcggtaacggcggggcggtgaagcagaaccccgaggttgccgggagcagcgcggccatagtcccggccccggtcccgccggcggagggtgagaggagaagaaggagagagtggaggagatcccggggaagggaagatgcctggtttaaagcagagcagcgcaaaagggtttctgttgcatcctgggtggtcgctgggaattcggtttaaaacctatttcaacaattcaaagaaacactggaaatatgggggatttcgttttttcattttataattcgaggctttggctcaccaattcaaaatttcacatacagagggggggaatgaactgaacgagaaaaacattatgaggaagtaaagttcctgggcaagagggcttaaaggagaggccttttggaaaattagcccccactttcatgcaaaataggggccaaaaatttttccaaccagggggggatattccccccccagg

SEQ ID NO: 88569 - protein, 163 aa, Zea mays
  misc_feature: Ceres CLONE 1575954
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSASGNGGAVKQNPEVAGSSAAIVPAPVPPAEGERRRRREWRRSRGREDAWFKAEQRKRVSVASWVVAGNSV

SEQ ID NO: 88570 - DNA, 792 bp, Zea mays
  misc_feature: Ceres CLONE 1575955
  misc_feature: Encodes the peptide sequence at SEQ ID NO. 88571
ctggagctccccgcggtggcggccgctctagaactagtggatcccccgggctgcaggaattcgtctcacccctagaaaaaacccagagccagaccacacctgatgtctgcgcagtaccctccctctcaggtagcgcacctcgcgcctcctccgccaaagggcttgtcacattttcgcctatctccggagaacccatcctgcgcctgcgagaagctctcttgttcgttggaccccccgccccccttggcaatgctggctaatccgccccctaggagggttaccgacatatcgattgtgccagagtttacggcagccaacacgacagaggtttggcgctgaagaaactatttgaagagggtgtagtgtaagcgagaagatctgtataccacctctgagctgtggaatgatcatcatgctcctgaagatgtgcctgacgcactaaatgacagccggaatgatttgcagcctgagtacctggatctttatcttatgcattggccatttagagtcaagaagggaacgaataccagccctgaaaattgtgttacacctgacttccctgctacttggggggcaatggaaaagctatatgatgctggcaaagctcgcgctattggtgtgagtaacttctcctcgaagaaattgggtgacttgcttgctgtagctcgtgtgactccagctgttgatcaggtggtatgtcatcctggttggcagcaaactaagctccatagctgttgtcagtcaactggtgctcatctaactgcttactcaccactaggggcacctgataca

SEQ ID NO: 88571 - protein, 101 aa, Zea mays
  misc_feature: Ceres CLONE 1575955
  misc_feature: SWISSPROT Homolog: EC 1.1.1.2 Alcohol dehydrogenase (NADP(+))
MHWPFRVKKGTNTSPENCVTPDFPATWGAMEKLYDAGKARAIGVSNFSSKKLGDLLAVARVTPAVDQVVCHPGWQQTKLHSCCQSTGAHLTAYSPLGAPDT

SEQ ID NO: 88572 - DNA, 843 bp, Zea mays
  misc_feature: Ceres CLONE 1575962
  misc_feature: Encodes the peptide sequence at SEQ ID NO. 88573
  misc_feature (15)..(15): n is a, c, t, g, unknown, or other
  misc_feature (16)..(16): n is a, c, t, g, unknown, or other
  misc_feature (23)..(23): n is a, c, t, g, unknown, or other
  misc_feature (30)..(30): n is a, c, t, g, unknown, or other
  misc_feature (47)..(47): n is a, c, t, g, unknown, or other
  misc_feature (50)..(50): n is a, c, t, g, unknown, or other
  misc_feature (55)..(55): n is a, c, t, g, unknown, or other
  misc_feature (56)..(56): n is a, c, t, g, unknown, or other
  misc_feature (215)..(215): n is a, c, t, g, unknown, or other
  misc_feature (232)..(232): n is a, c, t, g, unknown, or other
  misc_feature (236)..(236): n is a, c, t, g, unknown, or other
  misc_feature (249)..(249): n is a, c, t, g, unknown, or other
ctggagctccaccgnncggtggngcggctncgctctagaaaactagntgngatcnnccccgggctgcaggaattcgtctcacccctagaaaaaacacacccttcctccgctgcctcagctatggcagcgccgagctggatccggctccggcagtcgcgtgcaaccctcctcatcctgctgctcattgccctcaacatctcccttttcctcgccgncaacttcgagggcttcnactncgacgacctcccntcgcgggccgtgggcctcaatgctgaccataccgagaaagttttaaaaggttaaaactccggccccttcggccaatttccttttcaactttgggccaattaccttcccgtaaaaaaaaaaattcggggcgaaaacctaaaccccctataagggaaacccccctggaaacccccccccggggggttttaaccttttgggaaaaagaaaaaaattttgggggggctccccccttgggggaaaaggaaaaacccctctaaaaaaatatctcccccccccccggggggggggggcgccacctttaaatatccccccccccacaaagattttttttccaaaaaaaaaaaaatctcccgcggggagaaaggaaaaaccccccccttaaatctctcccccccccgggggttttttttttaaaaaaaaaaaaaagggggggggggaaccccccccagaaaaaaaggttttttggggttccccccaaaatatttttttcgggggggggggggggggaagaaaaaaaaaaaaaaattttttttgtggtgtggggggtggggccacaaaattttttctccggggggaggggacagtttctttttc

SEQ ID NO: 88573 - protein, 60 aa, Zea mays
  misc_feature: Ceres CLONE 1575962
  misc_feature (32)..(32): Xaa is any aa, unknown, or other
  misc_feature (38)..(38): Xaa is any aa, unknown, or other
  misc_feature (39)..(39): Xaa is any aa, unknown, or other
MAAPSWIRLRQSRATLLILLLIALNISLFLAXNFEGFXXDDLPSRAVGLNADHTEKVLKG

SEQ ID NO: 88574 - DNA, 997 bp, Zea mays
  misc_feature: Ceres CLONE 1575963
  misc_feature: Encodes the peptide sequence at SEQ ID NO. 88575
tccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcatgggaggcatgcaaatctttgtgaaaaccctgaccggcaagactatcaccctcgaggtggagtcctctgacaccattgacaacgtcaaggccaagatccaggacaaggagggcatccctccagaccagcagcggctcatcttttgctgggaaacagctttgaggaccggcccccgccttggcgactacaaaatcccgaaaggagagcacccctccaacttgggggctgcgcccccagggggaggcattggcgaattttcctggaaaaacccgggaaccgggagaaaaatatccccccctccgagggtgggagtcctccagaaaaccccccccaacaaaagtccaaggtcacaatattcctcggacaaagggagggttttttccccaaaacaagagaacgggttattttttgtcctgtaaaacaatctctgggaagaggtgcccagttggcccaactatcatactgcggagagggaacgcccctccccctgggtggtgggctttccgggggaggatggctatcctctgcggagacactagggtacgacattcccctttgtgggtggagttgttacccattgtaaaccttgtggaacacccccaaatgtgggcctccccgcccccacc

SEQ ID NO: 88575 - protein, 212 aa, Zea mays
  misc_feature: Ceres CLONE 1575963
  misc_feature (6)..(74): Pfam Name: ubiquitin Pfam Description: Ubiquitin family
  misc_feature (82)..(152): Pfam Name: ubiquitin Pfam Description: Ubiquitin family
  misc_feature: SWISSPROT Homolog: EC 2.7.11.1 Non-specific serine/threonine protein kinase
MQIFVKTLTGKTITLEVESSDTIDNVKAKIQDKEGIPPDQQRLIFAGKQLEDGRTLADYNIQKESTLHLVLRLMGGMQIFVKTLTGKTITLEVESSDTIDNVKAKIQDKEGIPPDQQRLIFCWETALRTGPRLGDYKIPKGEHPSNLGAAPPGGGIGEFSWKNPGTGRKISPPPRVGVLQKTPPNKSPRSQYSSDKGRVFSPKQENGLFFVL

SEQ ID NO: 88576 - DNA, 1213 bp, Zea mays
  misc_feature: Ceres CLONE 1575964
  misc_feature (15)..(15): n is a, c, t, g, unknown, or other
  misc_feature (16)..(16): n is a, c, t, g, unknown, or other
  misc_feature (1017)..(1017): n is a, c, t, g, unknown, or other
  misc_feature (1018)..(1018): n is a, c, t, g, unknown, or other
  misc_feature (1019)..(1019): n is a, c, t, g, unknown, or other
  misc_feature (1043)..(1043): n is a, c, t, g, unknown, or other
  misc_feature (1213)..(1213): n is a, c, t, g, unknown, or other
ggggggggggtgttnntagggatagggggggggggggggggcggggggggggggggccgggggtgggggggggcgaggggggaacccctcggggcggcggccgtggggagccgcgctaccctaggggatcccccgggctgcaggaattcgtctcacccctagaaaaaactcatcgtcggattcgtctcctgctcgtctcctaggctcctacacagctacagtttgggttcgcctggaacggtcatgtctgagggctgaggctgatcgatgcgggctccctgtccctccgtcgcactgacaaccctcctctcccgcctcctcgcgtgcaggtccgcctccgacgagctccagtgccacgccctcctcctcaaccttgggccacctcgccgcgtccccgctgggcctctccaacctcctcactcggggggcccgcgcgtccgttccccaggggccgccggcgctcgccggacggtgcggtcttttggcgtgaagtgcccaattttcccggtcgggcccggcgaattccatttccgcgcccgggaaaaacacgaggccctgtcccggcccccccatatgcccccgcggggggggccccccccctctccggcccggccccgggcttctctgagatctccttcgccgggagaagttccccccgcgttttttgccgcggtcgtcagggggtgcggcccacgcgcccaggcgctttacccgcgggtttgtcccgccccgcgcggggaactcccccgaccaaaaagcgggcccctttactcgcggggctgtttatgtaattttttcccctcttagggcgccctgcgtccactagaggcggcctcgtcgggaatctgcggccctagaaggatgcgaggcagacggcgcccttgatatcagcaccacccactattattaccagtgcaggggggcgtatctcttcgcccctccagagggggggacgcctctgtggttcgccacgggaggggagagacaaaggagcgagtcctttgtctcctctagcgnnnttggggtccggcaagaggggaganagagagaacctccgcgggaaggatattatcgaggggccaatcgcggacgtgtggagagtcacaatctttctccctctccgcctcaggagtggctctccgagggcaaattcatctgtttggtgcgccggtgggtttttggaggcgactcaaggcgcacggacgaatgatan

SEQ ID NO: 88577 - DNA, 897 bp, Zea mays
  misc_feature: Ceres CLONE 1575966
  misc_feature: Encodes the peptide sequence at SEQ ID NO. 88578
  misc_feature (652)..(652): n is a, c, t, g, unknown, or other
  misc_feature (653)..(653): n is a, c, t, g, unknown, or other
ggagctccccgcggtggcggccgctctagaactagtggatcccccgggctgcaggaattcgtctcacccctagaaaaactctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaacaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctactccccagcatggaggagctagaaactttagagtaatgaaatccttcagccagcaggcaggaaatcaaggtggactcggcgcagcttttccttctcatgccacctnntcctcatatgcccatccacaaggcctttcccttccatgtctatgggtactctccatataccccagactattgtttatccaacaaaacttctacaatattattaggagggagctcagtacccgttttaatggaaaagcaacagctggccttggggacaggaaccaagtccccttttatccataatttcaaatttggggcagttcgggaaacacttcctaccaactatacaagggggaaaagggca

SEQ ID NO: 88578 - protein, 197 aa, Zea mays
  misc_feature: Ceres CLONE 1575966
  misc_feature (18)..(88): Pfam Name: RRM_1 Pfam Description: RNA recognition motif. (a.k.a. RRM, RBD, or RNP domain)
  misc_feature (137)..(137): Xaa is any aa, unknown, or other
MSPPSVMGQFGDTTYTKVFVGGLAWETQKETMRKYFEQFGEILEAVVITDNNTGRSKGYGFVTFRDPDAAMRACVDPAPVIDGRRANCNLASLGVQRSRPPTPQHGGARNFRVMKSFSQQAGNQGGLGAAFPSHATXSSYAHPQGLSLPCLWVLSIYPRLLFIQQNFYNIIRRELSTRFNGKATAGLGDRNQVPFYP

SEQ ID NO: 88579 - DNA, 824 bp, Zea mays
  misc_feature: Ceres CLONE 1575967
  misc_feature: Encodes the peptide sequence at SEQ ID NO. 88580
  misc_feature (824)..(824): n is a, c, t, g, unknown, or other
atagctggagctccccgcggtggcggccgctctagaactagtggatcccccgggctgcaggaattcgtctcacccctagaaaaaagcaccacctccgtcaccagagccggcgccgtccgacttccagccatctcaggcacccgaactccgacccgatcccttgcttcaaaaagcaaaacaacaacaataactgaaagagaaagaacgccggagcgggagcctgacactgacgccatctctcatccttctcctcctccctggttcagatctctcatcggcccccgctgcattccatcccgaccccgtctgccactggtcacaccctctccatcgcttcctgccaccgaccacaccctctcgatcgccattcgccaccggccaaatggaggccatccggaagcaggcctcaaagttccgggagcaggtggctcggcagcagcaggcggtgatgaagcagttcgggggcgggtacggcgcagacggcgtgttcgcgaacgaggccgaggcgcaacagcactccaagctcgagaagctttacatctccacgcgcgccgccaagcacttccaaagggatatagttcggggcgtggagggctacatcgtcacggggtcgaagcaagtcgaaatcgggaacaagttatgtgaggatggcaagaagtacggcaccgagaacacttgtagcagtggaagcacactgtcgaaggcggcgttaagttttgctaatgcacgatccatgatggaaaaggaaaggggtaacctgctgaaagccctgggcacacaggtattagtcattgttgcctttatacccgtgatgtatgaatgcn

SEQ ID NO: 88580 - protein, 147 aa, Zea mays
  misc_feature: Ceres CLONE 1575967
MEAIRKQASKFREQVARQQQAVMKQFGGGYGADGVFANEAEAQQHSKLEKLYISTRAAKHFQRDIVRGVEGYIVTGSKQVEIGNKLCEDGKKYGTENTCSSGSTLSKAALSFANARSMMEKERGNLLKALGTQVLVIVAFIPVMYEC

SEQ ID NO: 88581 - DNA, 981 bp, Zea mays
  misc_feature: Ceres CLONE 1575970
  misc_feature: Encodes the peptide sequence at SEQ ID NO. 88582
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
tttgtttgatatgggaggacgctccctccgccccgcgacgcggggagggggcggcgtagtaatattatnnntaaactgggactccccgcggtggcggccgctctagaactagtggatcccccgggctgcaggaattcgtctcacccctagaaaaatctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccgggcgctgatgtgtccatgattggccagttcggcgtcggtttctactctgcctacctcgtcgcccgatagagttggtcgtgaccaccaagcacaacgaatgacgaagcagtacgtgggggggagtcccaaagggggggggggccggttcaccgggttaactccgtggacacggtcaaggggggagccagccttggggcggggggccactaaggaacgccacctgtttcccttaaagggagcgaattcggctggggggtaccctttggggggaaggggcggcccttccagggattctgggtgtcaaggaagggccttctggaagtgtctatgcaggggagcccccaaacctccccggggtgggaccgggggaaggggccacccgggagaagggagaattttctctagacccgaccgaaagaccc

SEQ ID NO: 88582 - protein, 114 aa, Zea mays
  misc_feature: Ceres CLONE 1575970
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGR

SEQ ID NO: 88583 - DNA, 1894 bp, Zea mays
  misc_feature: Ceres CLONE 1575972
  misc_feature: Encodes the peptide sequence at SEQ ID NO. 88584
aaacttccatcgccatcgctccaccaaaacctggggacgcctccccgcccgaccagcgccgacgccgacgacgagcatcccatccgccagtgaccgaaatttcacaccgggcgctgcaagcgactgcaatggctatgcaccagcgctccaagcgggcagccgggaactagctcatcagtcatcaccgacggcgtaatcttcatccgagtggtcagtggcgtctacagtcgcagcagcttgtgcgcgcatggctagcaacatgtacggcaccacggtggcctgtaggatgtgctacagagaccagtacaggccgccgccgcgcgacttcacctgcgaggccaggaaatcggaggccaggaggtggggaaacgggtaccaccacatccccaggctctgccagtggaagcccagaggcagcaagtctgatggctcactgctcggcgacggccacggtggccgcgatgctcgctgccactcttgtggttcccataacagctgcgagtgcgaaactagagactgcgatgctatggaagatgctgctgcgagctcttaccgagatttcaagcaacattcaaggggaaatcctcaattttcagataatcaagtttcattgaagaataagtcagcctatgctagtcaagggttggctgaagcctgcaaatttgtttacaatgatgctaagtttgtaaatgaaagggctcaaaatgacattctattactttcacgtggcataacaaggctgaacaaacgtgcatgccaggatgctgctgttttgggcctggggtttctcaaacttgatgctcgtgcacggaaggatactcaaaagattgaccacacagtgaaggagagagcagcgcttcttaaccattttgccagagcatttaaggagcgagctcagtcagacttgaagaaagctgcagacaaacattggagtgatggtgccttggaggcagacctgcgacgagctgacttggttgttaaacgacgtgccatggaagacgctttcatggcattgaagtttgttcaggatatccatgacatgatggtgaacagattatatgagcagcttccgaaggacggttcatcttctcgtacaaattcaacagggtttattacgcttgagaagaacgggaaggctcttgaactgtttcctggtgaagtttctgctgatcagatttatgccatagaggaagcataccagagtatggcatctgccttttctgaagctgatggtattgactacacagatcctgaggagcttgaattgttggtagcaactctaattgacctggatgccatggatgggaaaaggagtgtttccttgattgctgaatgttcaagctctccagatgttaatactaggaaagccctagctaatgcattggctacagctccatctatgtggactcttgggaatgctggcatgggtgcattgcagaggctggctcaagatcccaactacgccgtagctagggccgcatcaagagccattgatgaactcaagaagcagtgggaacttgaagaaggtgacagtctgaggtttgtgatgaaccagaatctggcctccggggatactgatgatgacaattcagccgcggatgatgccgcatgagtcgtaaacaagatgaaagattccagtttcagtggcaacggatcaaagcataaggaatcaccatgggcagcacataagcattcccattttacttttaggactgaaaatcagatagatgtgttctagttaaagggggggggggatgtgttatggaacttgggtaaatgggggaattctgaaaacagtgtaaatagaagtctgctccctttggatattgttcatgcatgaagcaaaatgttatatctgaaaaaaaaaaaaaaaaaaaaaaaaaaaaaaaaaaaa

SEQ ID NO: 88584 - protein, 454 aa, Zea mays
  misc_feature: Ceres CLONE 1575972
MASNMYGTTVACRMCYRDQYRPPPRDFTCEARKSEARRWGNGYHHIPRLCQWKPRGSKSDGSLLGDGHGGRDARCHSCGSHNSCECETRDCDAMEDAAASSYRDFKQHSRGNPQFSDNQVSLKNKSAYASQGLAEACKFVYNDAKFVNERAQNDILLLSRGITRLNKRACQDAAVLGLGFLKLDARARKDTQKIDHTVKERAALLNHFARAFKERAQSDLKKAADKHWSDGALEADLRRADLVVKRRAMEDAFMALKFVQDIHDMMVNRLYEQLPKDGSSSRTNSTGFITLEKNGKALELFPGEVSADQIYAIEEAYQSMASAFSEADGIDYTDPEELELLVATLIDLDAMDGKRSVSLIAECSSSPDVNTRKALANALATAPSMWTLGNAGMGALQRLAQDPNYAVARAASRAIDELKKQWELEEGDSLRFVMNQNLASGDTDDDNSAADDAA

SEQ ID NO: 88585 - DNA, 825 bp, Zea mays
  misc_feature: Ceres CLONE 1575974
  misc_feature: Encodes the peptide sequence at SEQ ID NO. 88586
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (783)..(783): n is a, c, t, g, unknown, or other
  misc_feature (784)..(784): n is a, c, t, g, unknown, or other
  misc_feature (787)..(787): n is a, c, t, g, unknown, or other
  misc_feature (788)..(788): n is a, c, t, g, unknown, or other
  misc_feature (797)..(797): n is a, c, t, g, unknown, or other
ctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgttcaagaacccaaggcgcccgtgttcccgcgcctggcgcagggcacgtcccacgacgagatgacggtgacgtggaccagcggctacgccatcgatgaggcgtacccgttcgtggagtgggcgctgccgccnnnnnnnnnngnnggnnggggggggngggcgcccccggcccacccggggggcgg

SEQ ID NO: 88586 - protein, 185 aa, Zea mays
  misc_feature: Ceres CLONE 1575974
MAVALLAALVASAAMFMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPRRPCSRAWRRARPTTR

SEQ ID NO: 88587 - DNA, 903 bp, Zea mays
  misc_feature: Ceres CLONE 1575975
aaactggagctcaccgcggtggcggccgctctagactagtggatcccccgggctgcaggaattcgtctcacccctagaaaaataggcttactgtcatccttatattcacagtgcacaatgtaaataaagaacctgataggcagtcttatgctgaaattgtgcaacgcagagtactgctccaaagtgcgtttacggctgcttttgattttgttggacgaattctcagaaggtgttcagagctccatgatattgcatcaagcttctatctgccagccattttggtctatattgaatggctggcgtcccatccagagttggctgttgattcagagatggaggaaaagcatgcaaatgccaggtctttcttctggagccaatgcatctcatttatgaataagttgatccttaccaaccttgcatctgtgaatgatgatgatgacgaggcttgcttttctaatatgagcatttatgaggaggggtgaaactgggcaacagggtttgcccctttggggaagaatcttgaatttgagaaggtttttctggccctttgctttccttgcacattacccattttttgggattttcctccaagccaaaacacaaccatttttgggaaacgcaccccaaagggaggaaagaaaaagccaccggggtgtccaagccggaattttttttttgcttggcagggaaaaaagtcacctggccctttaaccttttggttccagaatttggaatccaggtttgagagaattttttttttttggattttcccccaatccgaaaagaaaagtttttggtttagtgggcccaaaagaaaccccccccccgggtttttcttaagaaagataaaacaccccccctctctttccacaataaatctcccccgtggtagtcaccatttat

SEQ ID NO: 88588 - DNA, 873 bp, Zea mays
  misc_feature: Ceres CLONE 1575976
  misc_feature: Encodes the peptide sequence at SEQ ID NO. 88589
tggagctcaccgcggtggcggccgctctagaactagtggatcccccgggctgcaggaattcgtctcacccctagaaaaaagaacacactactccgtccctcgtctcctgcccaaaaccaatggaggccacgacagcgctcgcgctctcctcctcgtccctcgccaccgcacgccgctcgccggagaaggcgaccgctgcgtccctcagcctccgccgtttctcagctaccacctcgctccacctccgcgctgcacggagcccagcgcttcgctcgcaccagtcacccttccagggatggaggcggcgggggagggcgggcgggctggtggttcgcgcggagatgtttggccagctcaccaccggcctcgagtccgcctggaacaagctgaggggagtcgatgtattgacaaaggaaaacatagctgaaccaatgcgggatatcagaagagcacttttgggaggccgaatgtaaggttgccagtagtaagaagattttattgatcctgtaaggaaaaaggctggtggcacccatgtgatccgaggtggtccgacccgacccacatttgggggaaggttgggaagtgaagaaacggggaccacctgaaggggggggaagggatccaaaattggggggtttgccaaaatccgggggccaccttttttatttatttgggcagggcccccaaaggggtttggaaaaaacatactggtttttgggccaaaattttgccctttcctttcccaaaaaaaacggggggcaaaaaaccggtatggccacatttgccccccaaaaaattatatcaggggcccggcgcggcttttttttcacacccccccccttttccggggggagaaaaaaagggtggtggggg

SEQ ID NO: 88589 - protein, 117 aa, Zea mays
  misc_feature: Ceres CLONE 1575976
MEATTALALSSSSLATARRSPEKATAASLSLRRFSATTSLHLRAARSPALRSHQSPFQGWRRRGRAGGLVVRAEMFGQLTTGLESAWNKLRGVDVLTKENIAEPMRDIRRALLGGRM

SEQ ID NO: 88590 - DNA, 756 bp, Zea mays
  misc_feature: Ceres CLONE 1575979
  misc_feature: Encodes the peptide sequence at SEQ ID NO. 88591
ctcaccgcggtggcggccgctctagaatagtggatcccccgggctgcaggaattcgtctcacccctagaaaaagtactcctctctactctctgccccgccaccaagctcgaccgaccgatgatcctcagccgcctgcatgtccgcgtcacccgccgatcccccgcgtccgccgccctccgcgatgcggcaacgcgcgccttggcctccgcgggcctcttccgtggcctccacggcggcgcctcctccgagcacggccgcgaacccgcaggtcctcttacgctctacaggaagctagtgagccaagggaagctcacgcatgatagttaccaggaaaatgtagcttccgaattagacaacctacttagtaggcttcaacggtacgagatggaaaatggaggattatcatgaccaggctgtactttctggggagaatagccggggaagaaagaaccggcgcaaggctttctttgtccgaaaaaagctgaaaaaaaaaccaagccggggggggggggtatgggatttggatggaaaaaaaaaagggggatttttcttttgaaacaaaatttgggttttccccccccaaaaaaaaaaaaaaaagaggggaacccccctttaggaaaaacccccccgggagaaaattttgtggggaaaaaaaggggggggggggttctcccttataacccccccgggaaaaaccccccggggaagggaaaaaaaaaaaaaaacaccccccgcgggggaggacacacaccctg

SEQ ID NO: 88591 - protein, 96 aa, Zea mays
  misc_feature: Ceres CLONE 1575979
MILSRLHVRVTRRSPASAALRDAATRALASAGLFRGLHGGASSEHGREPAGPLTLYRKLVSQGKLTHDSYQENVASELDNLLSRLQRYEMENGGLS

SEQ ID NO: 88592 - DNA, 816 bp, Zea mays
  misc_feature: Ceres CLONE 1575981
  misc_feature (801)..(801): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaagtgctcgtctggccgcatactagtatccacaccagagaggagacacctccgactccgacctgctcttgcatatagattgggcagagagtgagagagagagagcgcgcgcgcgcgctcaagggggggccaaaaggagtttttttttaatacagcttcttagcctgaatctctttgatccggagagcagccgccagcccaactaatccttgctgctagcgcgccggggctccgattgcgctccagatctgaggcacctgctcggtggattccaggaatccgagcaccaactcgacagggagagttctcagggtaaaggtgagctcccttttccttctccctcctcatccgtccaccgttgccaaaactctgtccgtccgccgctggactggagtagtcgcgctcgcgctcgcgcctgtcttaagctctgattgctagctaatcttcggatgtttgcctctcggtctggttctgccgccgcctacactggaggacgacgcttgatgcacacgggacgggacaacgagttggccgcaagttttgtttgcacttgcacacgacccaccaccagctcacgcgctgtttttttttttcttcttaactcgctttgattgcatctgttgtttcggaaggaagaggctgagagcgcgttggagatttggactataagagcgagcgagcgagcgagctgggtgcttgagacgaaaaaaaaaaacccccctggaaaaannggggggaggcgcca

SEQ ID NO: 88593 - DNA, 864 bp, Zea mays
  misc_feature: Ceres CLONE 1575982
  misc_feature: Encodes the peptide sequence at SEQ ID NO. 88594
  misc_feature (864)..(864): n is a, c, t, g, unknown, or other
aagctggagctccccgcggtggcggccgctctagaactagtggatcccccgggctgcaggaattcgtctcacccccccctagaaaaaacctccgcacttccgctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggagggatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaggtacatgctgtggaatcaagagtgcagattgatgggaagtgtatgaccagtcgtggaccgggaacagccatggagtattctgttattttggttgagcaactatatggaaaggaaaaagctaaagaagttgctgggccaatggaggactgtctcattatattaagaaagacagaatgtatggggccagaaaacagcccaaacacaggagcctcctttactgagatgaaaacatgcaaacatagaagn

SEQ ID NO: 88594 - protein, 222 aa, Zea mays
  misc_feature: Ceres CLONE 1575982
  misc_feature (36)..(176): Pfam Name: DJ-1_PfpI Pfam Description: DJ-1/PfpI family
MASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMEDCLIILRKTECMGPENSPNTGASFTEMKTCKHR

SEQ ID NO: 88595 - DNA, 1183 bp, Zea mays
  misc_feature: Ceres CLONE 1575983
  misc_feature: Encodes the peptide sequence at SEQ ID NO. 88596
  misc_feature (53)..(53): n is a, c, t, g, unknown, or other
  misc_feature (54)..(54): n is a, c, t, g, unknown, or other
  misc_feature (61)..(61): n is a, c, t, g, unknown, or other
  misc_feature (63)..(63): n is a, c, t, g, unknown, or other
  misc_feature (740)..(740): n is a, c, t, g, unknown, or other
  misc_feature (844)..(844): n is a, c, t, g, unknown, or other
  misc_feature (850)..(850): n is a, c, t, g, unknown, or other
ccgccttttctcccccccccatttcttcatttcccgcccgaggtggtgactgnngcctttntntaataattggagctcacctcggtggcggccgctctagaactagtggatcccccgggctgcaggaattcgtctcacccctagaaaaaaaaacaagtttagatataaaaatatatcatcgcccgcggtctggagagtctggatcctcctgaacctccaagctgcaagcgatgaaaggagggacgcaagcaattagcctgatggtgcaccttgctgtgccatggatctgccttgcttcttgggcagctctgctaccagcgactagcatctggaaatggtgggtgcagcacctccgatactgagagcagattacataaaattgaacttcagcatcgcttcgagcgacccccgacaagtacaagagcttcatcgctcctgttcgtgctggtttggtgagcaaagcggggggcaaacaggagcgggatccccgagccggtcgactaaaacgaccccagatcgcgctcgaatcgaattcaaacctcactctgggtgaaacaaggcaggggtgcttccgtaaagctttgtaagaggggaatgtcctccaaaaccctacatccttgggctttaccctagctagggacagctgcatacgggcctcccccccaaaaagattaaaggctctgccccgactcctattttatggggaaaacccgggttaacctaacgggagggagaccccntctggggggaaaacaaaaggtagccagaacctctccttagtataaagagcacaaaccactggaccgcgccgagggaaatagccccggggccgactcgcggacgnaataanataacgctataggcgcggttccctgtgcttatattggcgcaaagtccgaaaatataatatttctgaggaaaaaaaggcgccatgatctcattcccaccctgcgttccggtggtttccccccagctgggagaaatcgcttgcccaccatgaaggataaggtggaaaatcggggggagtaagcctgttaatggagaaaaatgattgtgtcgtcaagaagatacgaccaccctcactcgaaaaccccgaaggagggaatagatcccctgatttgggagaaacccaagcgtgttgtataaatacccgctcttcgcggggccatagacccctgatctg

SEQ ID NO: 88596 - protein, 43 aa, Zea mays
  misc_feature: Ceres CLONE 1575983
MKGGTQAISLMVHLAVPWICLASWAALLPATSIWKWWVQHLRY

SEQ ID NO: 88597 - DNA, 627 bp, Zea mays
  misc_feature: Ceres CLONE 1575986
  misc_feature: Encodes the peptide sequence at SEQ ID NO. 88598
  misc_feature (297)..(297): n is a, c, t, g, unknown, or other
  misc_feature (505)..(505): n is a, c, t, g, unknown, or other
  misc_feature (506)..(506): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
ctggagctccccgcggtggcggccgctctagaatagtggatcccccgggctgcaggaattcgtctcacccctagaaaaaaccgcccagctgcaccctgcagcgctcactcgctcactgactcactcccctcccctggcctcctcctctctctctctctctccactctctcccacagccgaaccaacatgcaggggcgcagcagggacgccgccaccgtcgctgcagcggtggtgtgcgcagctgcgctgctcctcggcgacgcctggactcgtctcggcgcagggcggcggcggaangaggacaagataagcgcccctgccgggggcagccggccgggtgggctttcgccacaagaacttcccggggttttacaattcccggggggaacccccccccgggaaaaactcctcccccttttttaaacaaaattttcccccaaagggggaagggggggaacccgggggggcaaaaaacccccccccgggggggcctccttgggggggnntnnnnnnnnnngggaatttaaaggaggggggggccccccccgggggggggggcccccaccccctcccccccccttaaaaaaaaaaaggggggggggggggggtttttttttttttaacaaa

SEQ ID NO: 88598 - protein, 78 aa, Zea mays
  misc_feature: Ceres CLONE 1575986
  misc_feature (37)..(37): Xaa is any aa, unknown, or other
MQGRSRDAATVAAAVVCAAALLLGDAWTRLGAGRRRXEDKISAPAGGSRPGGLSPQELPGVLQFPGGTPPREKLLPLF

SEQ ID NO: 88599 - DNA, 846 bp, Zea mays
  misc_feature: Ceres CLONE 1575987
  misc_feature: Encodes the peptide sequence at SEQ ID NO. 88600
  misc_feature (321)..(321): n is a, c, t, g, unknown, or other
  misc_feature (322)..(322): n is a, c, t, g, unknown, or other
ctccccgcggtggcggccgctctagaactagtggatcccccgggctgcaggaattcgtctcacccctagaaaaactctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacagatcatctaatggatgggnnagcaacccataacctttaaaaatagtttggaaaaattttaaaaaatttcccggcccccccccaaagggggcccttttttgtaaaaaaatttgggggggaaaaacccccccccccaaaaaaaattttcggggggggggcgtcgggagaaaaaaaagggggagcacccccccccccccccccccggggggggggggcccccccaaaaaaaaaaaaacaccccccggcaaaaaaaaatattttttctttccccccccccaaaaaaaaagagagggaggcgggggaaaaaaatttttttctctctttggtgggggggggaaaaaaaaaaaaaaaaaaaaatataaaattttttttgttggcccgctcccacagatcccccgggtgtgtgttatataaaaaaaaaaaaaaaaaaaaatgggggggggggggtggggtcgtaaagaaaacacagggggggggggggtcgaggcgactgttcttccgtattggcctccgcgggggggagggcgggaggatcaacacaaaca

SEQ ID NO: 88600 - protein, 68 aa, Zea mays
  misc_feature: Ceres CLONE 1575987
  misc_feature (63)..(63): Xaa is any aa, unknown, or other
MAITAPTPDILGERQSGQDVRTQNVMACGAVANIVKSSLGPVGLDKMLVDDIGDVTDHLMDGXATHNL

SEQ ID NO: 88601 - DNA, 958 bp, Zea mays
  misc_feature: Ceres CLONE 1575988
ctggagctccccgcggtggcggccgctctaaagctagtgtatcccccgggctgcaggaattcgtctcccacctagaaaaaactccctccctgcccctgttctctctctcgaggttacagcccaggcgaccacagggcagctgctgctgactgcctaactctcccgcgcacaatgtatgtactacgttccacttctcgactgtgacaactgtcaccccggtctcgtccctcagccccaaaatagacaagaaatgccttggtccccagctccaccctcaccacgtgccgccctttacaccgctcctccattctgaatattccaatgatccatgctcgcgatctgagctgtcgtgcggcaggacggactctgcgtgtgcgtctcctccctcatctcctggctgactagcatctacctgctcggtctcacacccttcttcatatacaccatgacagcgacgcatcaagaagacatcccagcatgggcagcaacagcctcctggataggtgaccgaagatgcgcctcctcctcctacacacctccactgtctgctttgcactctgcaataaacgtcgtcgcctgcatctccaccatgattctcttgtaccacaacgtgaactgccgacgacccatctgcctgctcctcacttcggttcgacccaccgcctcctgtgttctcctcctgctggacgcattactccactgcttccttcgttgaataataaacaaaccaatctgtaaatctgcaagggatgggactgcggcatcctgcccccctcctccctactggcaactgcacgatgggtccatccatccttgctccgccctggaccggttgtaacttgatcaacagctctcctcacaaccggttttcctagcccttacactgcaccattgaaatcccccttggcggcctcccccggagtctgatcaaagagaaaaccccgccgcctccagaggc

SEQ ID NO: 88602 - DNA, 844 bp, Zea mays
  misc_feature: Ceres CLONE 1575989
  misc_feature: Encodes the peptide sequence at SEQ ID NO. 88603
  misc_feature (651)..(651): n is a, c, t, g, unknown, or other
ctggagctccccgcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatcttcgtgaagactctgactggcnagactatccaccttgaagtcgaggtctctgataccattgaacatgtcaagggcaaaatcccggacacaggaggggatccctccggaccacaagcggttcttttttggcggaaaacatcccgaggaagggggccacccctgccgaactacaaaattttaaagggaaagcccccccccattggggcgcgggggcc

SEQ ID NO: 88603 - protein, 226 aa, Zea mays
  misc_feature: Ceres CLONE 1575989
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (163)..(163): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGXTIHLEVEVSDTIEHVKGKIPDTGGDPSGPQAVLFWRKTSRGRGPPLPNYKILKGKPPPIGARG

SEQ ID NO: 88604 - DNA, 838 bp, Zea mays
  misc_feature: Ceres CLONE 1575991
  misc_feature: Encodes the peptide sequence at SEQ ID NO. 88605
ctggagctccccgcggtggcggccgctctagaactagtggatcccccgggctgcaggaattcgtctcacccctagaaaaagcaatagcccgtccccgccgccggattcgatcccgtctccggccgacgcgaccatttcccgcaccgccagatcctctcggctcggcccggccgccgcgcacctcccgcaattacagcgaccgcaataccagcaacgcctcctccacaaacggggcgggccgaggatccattcagccagtccacgcctttgactcgcactccgtttccagatctaggcgggcgggccgaggaacgatggacggagtctccgccccgccgccccaccggcggctgccggacttcctccagagcgtgaacctcaagtacgtgaagctggggtaccactacctcatcacccacctgctgacgctgacgctgctgccgctgatcgccgtgatcctgctgggaggccggcgcacggacccggacgaactgcgccagctctgggctcaccctcagtacaacttcgtgtccgtgctgggtcctctccccgggctgggttgggcccctttatggttaccccccccccccgttcctggaaaattgttttaaattccccgggaaccccgggcggggaatttgggggtctttttaaaaaataagggccccccccccctggggggtttcccaaaaccccgggggttcccgcaaaaaatcgggggcgcgggcccccggggaaaaatttcccccagggggggggggggccccccccccccccaagagaaacacccccgagaaagaggaggctttttttggggcggaaaaaacccttccttcgg

SEQ ID NO: 88605 - protein, 98 aa, Zea mays
  misc_feature: Ceres CLONE 1575991
  misc_feature: SWISSPROT Homolog: EC 2.3.1.119 Icosanoyl-CoA synthase
MDGVSAPPPHRRLPDFLQSVNLKYVKLGYHYLITHLLTLTLLPLIAVILLGGRRTDPDELRQLWAHPQYNFVSVLGPLPGLGWAPLWLPPPPVPGKLF

SEQ ID NO: 88606 - DNA, 953 bp, Zea mays
  misc_feature: Ceres CLONE 1575993
  misc_feature: Encodes the peptide sequence at SEQ ID NO. 88607
  misc_feature (947)..(947): n is a, c, t, g, unknown, or other
ctggagctccccgcggtggcggccgctctagaactagtggatcccccgggctgcaggaattcgtctcacccctagaaaaaaaaacaagtccatctagaccgttcctcctctaatccccatcctcgctccccccaaccctcaccgccatggcgaccaccgaggactccgccgccgcgggcgaggcccgacgcctgttcgccctcctcgagtcccagcagcaggtactctctgactgccacggcgcctggtcgcgcgccctcgcacactttgcctcgcgcgaggaggacctcgcctcccgctccgctgcactcgacgaagccctagccgccgccgacgtttccacttccgagactctcgcagcgctcgaggcccgcgagtcctccattcccgcgcgcctcgctgaggcctccgccgcgctctccgccgccgtcgctgaggccgagactgaatccaccgggccaccacccaccgacatcaagggcgcgctccggtggatatgccgccgcatggacgctgctgcgctctggcgcctcatggccgcacgccgccgggagctcgcggtagtccggaggggagccggccccgccgtcgccatgggcgtcgacccgccccgccttgtcctcgacgtggtaagcgatttcttaaccgcttggcaacgggttcggcggggacaatggctgggggcccggaatggtgctgcccccctttgtccatttgatgggaaggaacccccccaaaagggaaaacttggttgtaaaaggcttttgtcatacccaaaaaaggcaaaaccctttgggaaaaaaggggaaatttgtctcctaaaacaaaggggggaaaggcccaacctttgggccaaaacctcgggccccagaaaaaaagggaaaaaatttgccccgccgggtgggggaaaaacccccacaaaaaagggggacacccccggggggggngatggg

SEQ ID NO: 88607 - protein, 269 aa, Zea mays
  misc_feature: Ceres CLONE 1575993
MATTEDSAAAGEARRLFALLESQQQVLSDCHGAWSRALAHFASREEDLASRSAALDEALAAADVSTSETLAALEARESSIPARLAEASAALSAAVAEAETESTGPPPTDIKGALRWICRRMDAAALWRLMAARRRELAVVRRGAGPAVAMGVDPPRLVLDVVSDFLTAWQRVRRGQWLGARNGAAPLCPFDGKEPPQKGKLGCKRLLSYPKKAKPFGKKGEICLLKQRGERPNLWAKTSGPRKKGKKFAPPGGGKTPTKKGDTPGGGDG

SEQ ID NO: 88608 - DNA, 821 bp, Zea mays
  misc_feature: Ceres CLONE 1575994
  misc_feature (629)..(629): n is a, c, t, g, unknown, or other
  misc_feature (650)..(650): n is a, c, t, g, unknown, or other
  misc_feature (652)..(652): n is a, c, t, g, unknown, or other
  misc_feature (666)..(666): n is a, c, t, g, unknown, or other
  misc_feature (686)..(686): n is a, c, t, g, unknown, or other
  misc_feature (687)..(687): n is a, c, t, g, unknown, or other
  misc_feature (693)..(693): n is a, c, t, g, unknown, or other
  misc_feature (709)..(709): n is a, c, t, g, unknown, or other
ctggagctccccgcggtggcggccgctctagaactagtggatcccccgggctgcaggaattcgtctcacccctagaaaaaacgccctagcgatccgttctcatttgcagacccaatccaagcccagagcaatcaccaagcctggcagattagatttccaccctcacatggaggaaaaatccaaccttcgcatgtgacctctatttaaatccccgcaagaatcgatcaatcaatccaaaagggtgcaggaaaacagagcaatcccgttgcttagcgtgttcgccttgccgttggcgtctcttctccgttcctcggcacgcgtaggcccataaacctccgctaaagctcctttgtcgcgcccatttcgtcagccatttcccagattccccataggcgagggttcccgggctgagatccaatcttttcagttgttcggtttcaatcggtgtaaattcctccagaaagaaacctagaatcgcccccccatagttggaaaaggtttccatttctgaccggttgtcgagcctggctacgttttgccgagcaaaggcagggcgtccgttcggttacgggttcttgatccggcgagggaccgccgctgccgaagcaatgcagctggacccgtcaggnccgggcaggggggaaggcggncngcgctccatgcgcnacccgcggctgccgccgccnngtgacngcgggggtcggctggncgggcccggcgtccggtgcctgcccgcaccaagaacgggaaaaaagtgggggcggaaccacttaccccaaatctggggaaaaaaaaaacctgggggcccggggggggaattt

SEQ ID NO: 88609 - DNA, 1149 bp, Zea mays
  misc_feature: Ceres CLONE 1575995
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (258)..(258): n is a, c, t, g, unknown, or other
  misc_feature (1149)..(1149): n is a, c, t, g, unknown, or other
tggagctccccgcggtggcggccgctctagaactagtggatcccccgggctgcaggaattcgtctcacccctagaaaaaaaccagaccattctcctctccgaattcaataattcctccgccgcaccacgcttcctcctcctctgctccgcctcttcatccagcgagcgtcctccgattgctgacggatccctcctcgccgccgccgcgggccgaccgtggggagaggaggggaggcgggagtgatggaggnnnnntcnccacttaagccctcccaatgaggaccttgactcccggctcctctgctgtcaacgaagcgctattcaccgccgacgtgtacactcccgaacactgtcacatatttcgagggcatgaggtcctcaattacatatgaagcacccccagggactcgccttagtctccatcgccgtacttaatagcgataaaggattactcccgggcaatcccccactattaattattgtgtgactcgccggcggtgtgactcacgactgctttggacggtttgtggtcttacagagcctttacaatgaagtggttacgagaagagggatgctccattgtttttctttggatagggtggccgcggttcctccccgttgtggtaaaatgccgtatacaccctacgacgctgataataagccactgtgaaaggaggggaatatcgacttgtctcctaacccctcttaggtgcaaagggaaggctctgcgtcgtggagacacatgatattctatgggcatggacgtcttccatataccatgtagctggcatggtgttggttgtatcaacctctcgcttgattgatgtactgaccctcgtctctgctgttgtttggcacaactcctaaggcgttcctccaaatagctcgtgctttgtacggactaccacgattatctacaccctactacgtttatatccactcttgaattgtgcggttattattctcgacccttgcacttttaagaaagtgcgaagcggcttcacatcgagcgtctcttaatatatctctaccatcgtgtgttaagtaggcttctctaatgtgtactgtatcaccgtgggctctgtgcgtctgcatgttagagcaagtgtgtgcgtggctgcctcctatggatagcatcagcatataatn

SEQ ID NO: 88610 - DNA, 820 bp, Zea mays
  misc_feature: Ceres CLONE 1575997
  misc_feature: Encodes the peptide sequence at SEQ ID NO. 88611
  misc_feature (790)..(790): n is a, c, t, g, unknown, or other
ctccccgcggtggcggccgctctagaactagtggatcccccgggctgcaggaattcgtctcacccctagaaaaatgctctctaatggcattaactgccgcccacccacccgccatctcctcccctacccagctgcacgctcctcttctcctgctagcagtactgctatatatcaataatactagctggaccctttccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagggtgtggggggaagccacctacgacctcgccaccgtgctcgccttcctcgccgtcctcgccttcaccatctccgtctacatcatgtccaggcccaggcccgtgtacctcatcgacttcgcatgctacaagccggccgaccagctcaaggtgtccaaggcggaattcatcgacctggcgcgcaagttcggcaagttcgacgaggacagccggncgtttcaatcgcgtctgctggccaagtccg

SEQ ID NO: 88611 - protein, 53 aa, Zea mays
  misc_feature: Ceres CLONE 1575997
  misc_feature: SWISSPROT Homolog: EC 2.3.1.119 Icosanoyl-CoA synthase
  misc_feature (44)..(44): Xaa is any aa, unknown, or other
MSRPRPVYLIDFACYKPADQLKVSKAEFIDLARKFGKFDEDSRXFQSRLLAKS

SEQ ID NO: 88612 - DNA, 1163 bp, Zea mays
  misc_feature: Ceres CLONE 1576001
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
attataatataaaattttatataaaaaaaaaaaatgcacactgagaaggaacagannntaggggttcttgccaagctgggactccccgcggtggcggccgctctagaactagtggatcccccgggctgcaggaattcgtctcacccctagaaaaaatttttttcgcccgccgcccccagtcccgatccgaagctgtgcctcgtaccatttcgatccaatggcgccgacgtcgaagctgtcgacgggcatctagcgcgcttcgcggtcgcacgcgtaccatcgccgtgggctgtgggccatctaggccaagaacggcggggccttccccaaagccgacaaggccgcccgccgccgtggaaacccaagttctaccctgccgacgacgtcgagccccgcgttcccagcaaccggcaagcctaagcctaccagggctcagggtcgagcatcaccacctggggacgggtggtaatacgtcctcgcgagggccccccccggggggaaaaagaggggggtgttttcttaaggccaacctcaaagtcccggccctgccttcccttaatagctgggggcccattttccaaaaatcaaatggggaggtacccgaattcccccccggtggggaaaatccaaaaaccacaagggggcctgttgtgtttacctgttgtgggccaggatggtggggaatccctcccccggggggggttgggttgctcctctccccaaaaagtcttctggcgagaatacccaatttgttactctttttgtgccctcgggttggttacaatttattcgacaactcacaaaataatgggtgttaatgataatatgataagccccctgctaggggtgggagatgattttctttgttttgcgggagtgcaccactgatgtattacgggagggggcgatgtgtcaccaaagtggttggttcggggggggcggtgtggtaacttattttctgaaaaaacgagggggtctcgatccccccgcgcgtatcgctccactactggtgaggtatcatctctccggcgccgacacgggtctgaaaagggggggagtcgaggttccgtcgagttggcgttggctgttaccacgcgtatatctgttgttgaggctcgtacctgctggctgtgcgagggcgtgcgtggcagcccttgtctcaa

SEQ ID NO: 88613 - DNA, 802 bp, Zea mays
  misc_feature: Ceres CLONE 1576002
  misc_feature: Encodes the peptide sequence at SEQ ID NO. 88614
tggagctcaccgcggtggcggccgctctagaatagtggatcccccgggctgcggaattcgtctccccctagaaaaaatcctgccttgagtgttcgtgcaacgctgcccctgccgcgtcgtcttctcgactgcttctccactccgcccagctcgcagtcgcagctcgctcaaagcagcacagcagcaagcagaaggaagaaaaacagcagcgggaggcgagaagagaagcgcgccgccgctcgagctcatcccgccgccggacacacacacaccgccatgaggcacagggcgcggtcctcccccacctccccgctcaccccgtcctccagcgcaagaacaaacaagatacttggtttctctgtatctctcatcctcatcaatctggcttcaattatggagcgtgctgatgagaatctccttccagcagtttacaaggaagtcagtgcagccttcaatgctggtcctacagatctgggatacctcacctttgtaatgaactttctgaagtcaatagcatctcccttggcaagtatccttgctctgcactatgatcggccaatagtgcttgcaataggggactgttttttggggccttatcaacagggggctgtcggtgtttagcccagcgttttggggcagggttgccatccgtgaaaaagccggtaaatggggcctaggggctttgcccctttgtaaataaccagggggccttcaggtcggtttctatggcctggataggcttattaaaagaaaggggatcccccccggggggggccagggggtttcccgggtgtttgtttat

SEQ ID NO: 88614 - protein, 114 aa, Zea mays
  misc_feature: Ceres CLONE 1576002
MRHRARSSPTSPLTPSSSARTNKILGFSVSLILINLASIMERADENLLPAVYKEVSAAFNAGPTDLGYLTFVMNFLKSIASPLASILALHYDRPIVLAIGDCFLGPYQQGAVGV

SEQ ID NO: 88615 - DNA, 1034 bp, Zea mays
  misc_feature: Ceres CLONE 1576004
  misc_feature: Encodes the peptide sequence at SEQ ID NO. 88616
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
atggaagatcccctattattatcctcccatatcccccttaaaaaacaagagaaaannnncnanntttatncaaaactgggactccccgcggtggcggccgctctcgtaccaaggaatgtggtgggttgtgcgaaggcctgatgagagtagaaaaagctggcggtcaacactggtgacttgatgcacatctggcggctcgtcgacgaaaaggagggaggcccgtcttggatttacatgatggagcgcaccattaccaaccatgatgtaccaagcctggcggagagacccaccgagtggtccaccacactaccggagcagcacaatcttggaagatgcgtcaccagaggttgtgagagatttcttctgggacaacgagttccggatgaacaacagctgggacgacatgcttcttcagcacgagacgctggaggagtgcaccgagactggaaccatggttgtccggtgggtcaggaagttcccgattcttctgcagcgacagggagtacatcatacgccgcaggatatgggcgtctggggaagacattttactgagctgaccaaggggtggatccctcgttccctccggttccaagaccaaaaaaaaccttcgccgggtaggacttggtactaccttctaggcggggggaattccgtaccagtctgaagttcgagaaaaaagggcgaacggttgtcaattggagttgccattgccgaaaggtggcttctctgatttccaacccacgagggaaaattgggggtaattcccaatggggaagaaatcgcgaaaaaccttggcccttccgggagagggggaaatggtgggggggtggctttcacagaggggattaaaagccctgggacctttctgggccctaaacccagatatttgggaaggcaacccccccggaaaaaggttttttttttcaaagggggggggtgggcaaggggcccatggggtgaaaccacccaaagtttttaaggggcacgaaagcaatactctcatcaatacctcagggggggcaggggggaaaagg

SEQ ID NO: 88616 - protein, 134 aa, Zea mays
  misc_feature: Ceres CLONE 1576004
MMYQAWRRDPPSGPPHYRSSTILEDASPEVVRDFFWDNEFRMNNSWDDMLLQHETLEECTETGTMVVRWVRKFPILLQRQGVHHTPQDMGVWGRHFTELTKGWIPRSLRFQDQKKPSPGRTWYYLLGGGNSVPV

SEQ ID NO: 88617 - DNA, 814 bp, Zea mays
  misc_feature: Ceres CLONE 1576007
  misc_feature: Encodes the peptide sequence at SEQ ID NO. 88618
aaagacggagctccccgcggtggcggccgctctagaactagtggatcccccgggctgcaggaattcgtctcacccctagaaaaaatcagccatcccattttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaagctgtctggttcaagaccggcgcgctgctcctggacgggcacaccctcaactacttcggcaacagcatccccatcaacctggtggatggccgtgatcgcggaagtcatccctcgtcgggcggcgcccgagtacttacgggatcaccaaacggactggaacctaaaggacaaagctgcacccccggtggggccccttccaaccccctggggccatgggcaggcgacccccggaacaa

SEQ ID NO: 88618 - protein, 225 aa, Zea mays
  misc_feature: Ceres CLONE 1576007
  misc_feature (83)..(221): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGHTLNYFGNSIPINLVDGRDRGSHPSSGGARVLTGSPNGLEPKGQSCTPGGAPSNPLGPWAGDPRN

SEQ ID NO: 88619 - DNA, 858 bp, Zea mays
  misc_feature: Ceres CLONE 1576008
tggagctccccgcggtggcggccgctctagaactagtggatcccccgggctgcaggaattcgtctcacccctagaaaaaagggatcgatcgcgccgctatagctgctgcacgcctgcacgctttgcctcctcttcttcgttctctgccgctgcgctagctagctgcggctccgagcctccgacgcaggaagtctaatgtggaagtctctcagaactgagtacttttgttagaacaaagatttgttcagtcaagctttgcaaattatcatcatagtttggatgatatccatggttactttaatgagtttatggagccctggttgccgagcttatctgggttctctgacaatggaactgtaatatttgcaacagaacctttcttgtattggaagaaagtttcaagaggggttaacaactttgatgacgtgttcgtgagggcaaagtgggagagcaaaatttcttcgcatgcagatgtcaacaggttctaaccactatggtgtatttccacattcattctgcaaccaacatgttgtttcgtttcagatgagttcaattactagtgggtcaggagccataacagtttgtctagacacctccagtggaatgaatggtgacatgggcatgttgaacactacatctgtcacaattgtatccactggttcaccaaacgtggttgctgattcttcttgccggaacctccagtatagtgcacccttggctgtggagtggtcctatccgggagctgcaattgttacaacgatggccctctacaggtatgcagatgcagcccggaatcatgaagtacataacgatagcagcccactttaccagacaggacagttagagatggttgccatt

SEQ ID NO: 88620 - DNA, 836 bp, Zea mays
  misc_feature: Ceres CLONE 1576011
  misc_feature: Encodes the peptide sequence at SEQ ID NO. 88621
ggagctccccgcggtggcggccgctctagaactagtggatcccccgggctgcaggaattcgtctcacccctagaaaactctgctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtagctctttagggttcgcgatttctcgccgatcggttcgagaattggtaagctatggatctctcgcggcccacatcgtcggacctctcgctcgggctccactctcacggtcacgcccacgcccacgctcgcaggcacgcggtagccgcgccgctgcgcctgttcgacgacgcggaggagccgaaaccggagcgcgtcgtggccggagaggcccacgcggagagggatgacgaggacgggggcgaccagcactttctccctcctcgggcactctcctcttcgtaaaggggccgcggcggggccggcaacggccggcggggggccgaaaaaaaactcatcccggggtcggtccaccttcccgggggggtttttcgccctggccaaaaggaaaagggggaaaggggggggaggggcaaaccccgccccaaaatattgggaaaaacccccccccggggcccggagggttcccaccgccccgtggggggaaaaaaaataaacccccttggggggggaggagggcccccaaacaccggggaa

SEQ ID NO: 88621 - protein, 76 aa, Zea mays
  misc_feature: Ceres CLONE 1576011
MDLSRPTSSDLSLGLHSHGHAHAHARRHAVAAPLRLFDDAEEPKPERVVAGEAHAERDDEDGGDQHFLPPRALSSS

SEQ ID NO: 88622 - DNA, 1178 bp, Zea mays
  misc_feature: Ceres CLONE 1576012
  misc_feature: Encodes the peptide sequence at SEQ ID NO. 88623
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (43)..(43): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (74)..(74): n is a, c, t, g, unknown, or other
  misc_feature (773)..(773): n is a, c, t, g, unknown, or other
  misc_feature (881)..(881): n is a, c, t, g, unknown, or other
  misc_feature (1013)..(1013): n is a, c, t, g, unknown, or other
  misc_feature (1178)..(1178): n is a, c, t, g, unknown, or other
ttttttttttttttttttantttttnntttagggttttgtttngggggagggtgggnnnnannnnggttaattnttgcaaactgggagctcccgcggtggcggccgctctagactagtggatcccccgggctgcaggaattcgtctcacccctagaaaaacatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttacccagacaccggagggccaggttgtctacatccttggaatcaaagtgcgccgcttatggaaaaacgaaaatgcttggctgaaggatcaaaccacgtggtggttctttggaaattccacgcccaaaaatattcccttaattgggtccaaccgacgggtttgccttccccctggaagtgcaaaacctggggccacccagaccctggggttgggtcccaggcgacccccattttgagagagaaataggagactcccttgtgtgtggtaaccccgcggaggcgcacacacgtggtgctcccntaaaagtgcaccccctatcccacgcggaccggggtcagacccccttgttcttttctggagagaattacaactctataaaatatagcgggcgtgaaatctcccccctcnttcccccccacacagaaggtggtgcgagaatcttctaccctccgttaacattttttttgtggaaagggtcctccagggtgtcccgcgggtaatatatctcttagtggaagaaaagaccgcctaaacaccccnccgtttgtgagtaaacaccatggaggagccgccgcaccgttgaagaaagatagtagtctctttgggaaaaagagagaacactccaggagggggggttagaagcgctcacaggagaaaaacgagggagaaatgtgagacgaggtaaaaaaaatctctacatatgtn

SEQ ID NO: 88623 - protein, 185 aa, Zea mays
  misc_feature: Ceres CLONE 1576012
  misc_feature: SWISSPROT Homolog: EC 2.4.1.13 Sucrose synthase
MMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGPGCLHPWNQSAPLMEKRKCLAEGSNHVVVLWKFHAQKYSLNWVQPTGLPSPWKCKTWGHPDPGVGSQATPILREK

SEQ ID NO: 88624 - DNA, 837 bp, Zea mays
  misc_feature: Ceres CLONE 1576013
  misc_feature: Encodes the peptide sequence at SEQ ID NO. 88625
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (59)..(59): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (68)..(68): n is a, c, t, g, unknown, or other
  misc_feature (75)..(75): n is a, c, t, g, unknown, or other
  misc_feature (76)..(76): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (95)..(95): n is a, c, t, g, unknown, or other
  misc_feature (99)..(99): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (123)..(123): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
gggggggggngggnnnngnngnngnnnnggngggnngngnnngnnggnngnngnggggnggnnggtnngggggtnnggggnnnnnnnnngnnngngggnggnnnnnnnnnnnnnnnnnnnttntnnnnnnnccaaactggagctcccgcggtggcggccgctctgaacagtggacccccgggctgcagattcgtctcacccctagaaaaaacaatctaacgtactccaggctccagctgatttgtccacgcggcatggcgacggccagcgccgcttcaagcttcctcgtcccggcgactgctatcgccccgacaccctctgcatgcccatccacggttcccaagaacaagaagaatgctgccggccggcggcggcgcacattgcagtgcaaggggccagccggcccggcgggggccgaccaaccaaaaaaacagccccccctcccttcttgggcttgcccccccgggggggggaaaaattggcttaaaacccgggtctcggggggcgggggcctttgggcccccccccccaaagtttttttttttttgggggggggaaccccccccggggaaaaaatttggggggggtttttttcaacaaaaaaaagcccccccccctttggggggaaaaaaaaccccaaaaaaaccccccccccccttttgggaagaaaaaaaaaaaacattttttccccccccccccggggggggggggggggggccaaaaaaaaaaaaaagaggggggggggtccccccccccaaaaaaaaaaaaaaacccccccccggtggggggggggaaaaaaaaaaaaatctttttttcttttaaaaaaaaacccccccc

SEQ ID NO: 88625 - protein, 194 aa, Zea mays
  misc_feature: Ceres CLONE 1576013
MATASAASSFLVPATAIAPTPSACPSTVPKNKKNAAGRRRRTLQCKGPAGPAGADQPKKQPPLPSWACPPGGGKNWLKTRVSGGGGLWAPPPKVFFFLGGGTPPGEKIWGGFFSTKKSPPPFGGKKNPKKTPPPLLGRKKKNIFSPPPRGGGGGAKKKKKRGGGPPPQKKKKTPPRWGGGKKKKSFFLLKKNPP

SEQ ID NO: 88626 - DNA, 959 bp, Zea mays
  misc_feature: Ceres CLONE 1576014
  misc_feature (729)..(729): n is a, c, t, g, unknown, or other
  misc_feature (799)..(799): n is a, c, t, g, unknown, or other
  misc_feature (917)..(917): n is a, c, t, g, unknown, or other
ctggagctcaccgcggtggcggccgctctagaactagtggatcccccgggctgcaggaattcgtctcacccctagaaaaaagatcgacgtctcacgctccaacagggtcagtcgcgatgcttcccttcccggcggcgacgaccacctggaagcttggcatctgcgtgctgctctaatattcatgcctcttcttcctctagaaataagtgcgactcagacacaaaatggcgctcgtgctggtgcgcggctgcgccgcggcgcgaactgtcacatgctacccctgtggggtcctgggtgactcggtacctgcatagacctggtgcgcttgtggccgtccgactgaccgcctattccggtttgtccggccaggcggcctactctgccaactacgaccgcgactaccggactgtgggcgggctcaaccggcacgtaatcgctaccgacaaagagacgagcgccaccgccttctacagcactgcttacagggtgatctgagaattccggcgctgagttctcgcgcggcgtgcactcggtcatttccggtgctcgcttctgcgctttctgaatgggtgtgccggcctatagagagacaccaaacgcagcggccaagaagtgctcagggtggtcatacgcggtagatggccctcgaaggggtccacgccagcgaggcgtattctgctggaaggatctgaagacatgtgcgatgagtggaataggacggtgctgaanggagggaacggcgagaaatacccgctttaaagcgatcatgaactagcagggtctcgatgatcgggagtgncactgtgaagatacgacgaaacgatgaacatagccttggcttgagagctcaatacaaatggggcacgtatcgtgatgaatctactgagaagagttcgagagagcaagaggtgacgatnagcacgggctggacgtcctcagcaccgaatcggatctcatgt

SEQ ID NO: 88627 - DNA, 855 bp, Zea mays
  misc_feature: Ceres CLONE 1576016
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgccctgagctcgtccccaccgtgcaccaccgggccgggcgggtttctccaggcaggtgtggggcacctggacgaaaaaacgctttcaagcgcccgtccgtcgttttctccgcgcttatctttggtcgtccgcctcggggaaaaaaagcccaaacagggaagcccgccccctggggaccaatcgaaggacgttggacccttaaccttttcataaggggcccccgggccaaaaaaaaggggggaaacctccccccccccccgggggggcccggaaaaatcccccccggggggaaaaaaaaaaaaaaattgggggggggaagagggggggttttttttttgtgggaaacccccccctttgagggggggggggggtccccccccccaaggaaaatacctcctccccctccgggggggagattgtttcccccccagggccccccctcttaaagaaaggtgttttggtataaaaaaagaagggggttttttccccccccccctcttgggggggggggctccgtttaaaaataaccccgcggggggaaaaaaatctttttctctctccaaagaaaagaggggggggg

SEQ ID NO: 88628 - DNA, 811 bp, Zea mays
  misc_feature: Ceres CLONE 1576017
  misc_feature: Encodes the peptide sequence at SEQ ID NO. 88629
  misc_feature (489)..(489): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (680)..(680): n is a, c, t, g, unknown, or other
  misc_feature (683)..(683): n is a, c, t, g, unknown, or other
  misc_feature (705)..(705): n is a, c, t, g, unknown, or other
ctcaccgcggtggcggccgctctagaactagtggatcccccgggctgcaggaattcgtctcacccctagaaaaacatgatgttgaggacagagtccgcagtctcagtgctctgctaggtgcgctgaggaaggctgatgagcacctgtccaccctagaagctgataccccatactctgaatttcaccacatgttccaggaacttgctctggagaagggttggggtgattgcgctaagcgtgctcaagatactatccacctcctcttggacctcctggaggccccagatccgtccaccctggagaagttccttgaaacgatccccatggtgttcaatgtcgttatcctctcccctcgtgggtacttcactcaagcttatgccttgcgttacccagacaccgtagggcacgttgtctacatcatggatcaagtgcggcgcgatggagaacaaaatgctgctgaagatcaaacagtggggtcttgtcatctcnactaagatacgtttttgtcacccggttggctccctgaaacagctgggtccttccctgaagagccagccccccaattaaaaaagggacctttggaacccgggaggaactggggccaataaactttcgccgggggggcacctttttttttggggagaaaaaccccccaaannnnnggnnnnnnnnnnnnnntnttnttggggggggttgggtgctatntggttacggttctgattgatgttcgggtcggcgcccgattcagcgtcaatcggtgttcattccacggagagatatggtgaattcagacgacgggggaggggatcga

SEQ ID NO: 88629 - protein, 162 aa, Zea mays
  misc_feature: Ceres CLONE 1576017
  misc_feature: SWISSPROT Homolog: EC 2.4.1.13 Sucrose synthase
HRGGGRSRTSGSPGLQEFVSPLEKHDVEDRVRSLSALLGALRKADEHLSTLEADTPYSEFHHMFQELALEKGWGDCAKRAQDTIHLLLDLLEAPDPSTLEKFLETIPMVFNVVILSPRGYFTQAYALRYPDTVGHVVYIMDQVRRDGEQNAAEDQTVGSCHL

SEQ ID NO: 88630 - DNA, 1142 bp, Zea mays
  misc_feature: Ceres CLONE 1576018
  misc_feature: Encodes the peptide sequence at SEQ ID NO. 88631
  misc_feature (1142)..(1142): n is a, c, t, g, unknown, or other
tggatctcccctctgtggcggccgctctagaactatgtggatcccccgggctgcatgaattcgtctctcccctagaaaaaacgggccgcggtttctgaaaaggagaggcgtggtgggaaggggagggggagcgggaggggcctcccctcacattactcttcttcatccatcttcattattcctccatctcactctccccttctctcttagtgcccttctctcctcgtcccttcccccttccctctccttctctcccttctctcgcgccacacttacgtctcctattgtattcttcactcttttatttttatcgctcctcctaactctcttttttcttcttctcctttcactttttttttcttacaccccgtctcacccacctcactcttctgctccccccccccgatcttacatctcttgctgttcctcttcatctccctctccctcttatcttttttttctcttttttacatccattttctctcctcttctccttttctctttttacctctttttatcctctctcttccttttttttttttccttcctcttgttcctaatcttagaccccattttcctttctttttctttttcccctttttccctttcttttaatttcccctcactattttttttcttacactcttcccccttctttattctcctttgtcctattatcctcctctccttagtcttctcctcttaactgtttctattcccctccttattctacactcctaatctgtacttctcctcttcccctatattccttctactacttttaattaccccacatttattttttctttctatttatcatttcataacttccttatcccttttttttttcctttcttctcgccctacttttccttcctattcctccctctttatcgttatatctttccattttcactaactccttattctacctttataacatttataacaccccatttcttgtatctactcctcttacttctctaatcgtttttctcctctcttctttttcctctttactatcactctttttcttttcccctcttatctcctttccctcctattttttccccatttacttttctactttcttcttttatatccccttcttctcttattttttttgctctcttaccttttcn

SEQ ID NO: 88631 - protein, 31 aa, Zea mays
  misc_feature: Ceres CLONE 1576018
DLPSVAAALELCGSPGLHEFVSPLEKTGRGF

SEQ ID NO: 88632 - DNA, 952 bp, Zea mays
  misc_feature: Ceres CLONE 1576019
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (90)..(90): n is a, c, t, g, unknown, or other
aaaatcgttaatgttctacaaaataaaaaaataaaaaaaacctaactcccacaaaaaaaaannnnnnnnnnnacaaactggagctccccncggtggcggccgctctagactagtggatcccccgggctgcaggaattcgtctcacccctagaaaaaaaatctaacgtactcaggccttctctgatttgtccagacggcatggcgagggggacccgcgcttgaagcttactcgtctcggagactgataacgacccgacaccctttgaatgcccatccacggttcccaacaacaaaaagaatgctgccggacgagagctgcggacatagcactgcacggccagctccccgcggggcgaccacgaagagagccacctcctctggctgcccccgcgggaagtgctgaccggtctgggcggggtggtcgccagcttcatcggggacccggatctggattccatcgccctgcaccccaaccccggggacagctgcctgatgggcgagaaggtgaccgaaaagctggtggagggctcctgaccccaacagagatttcgcgtgcccgatagcgtcaccggtccccatcatggacttcactccggagacgagggtgacgcgagtccgcacgtcgggcgcacctcctggacccggagtaccactagatgtacaccctaggcgggggggcaaagacgccgacgctcggactggtcgaaaacgctgcaccttcacggcccaagcgggcccgccatccttcccaactgccaacgggaaactacccggctgaaccccaaccggaaaaagaaacggctccattgaaccgtgaactatcatccggggaatctttcgccgccccttggcacccggactgtaaacaacaaacctccctacgaaagggacaacccctccgggtcatggtttcaaaggggcaaaaaaaaacacccctaataaagggcttgcc

SEQ ID NO: 88633 - DNA, 1187 bp, Zea mays
  misc_feature: Ceres CLONE 1576021
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (27)..(27): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (996)..(996): n is a, c, t, g, unknown, or other
aaggttacggnnaactanacggtacgnaaaacgagtcaggggacggtcacgttacccnnncacagtnnnagnnaaaaactggagctccccgcggtggcggccgctctagaactagtggatcccccgggctgcatgaattcgtctcacccctagaaaaactttttttcgaaattcgtctacgccctctctctcgcgggccagctggtctattgccgcactagctagatctagaaaaaaagtttgtccccaatccgaaccgactaggagctcgccgccgtgagatgtccgagtacgacaagccctaccactgcaacgccgacatgcccgcatccgaaggcggctatcctccggccgagtagacagccgcacccacgcctgccgccgggggttcggcgcccgcagacagcaagcccttcgggttctccgaccacaccgactgcggctcctcccgggaccaggatgagacacaatcacatgggcgccccccccctccaaatctcaaagaaagggtaccgagaacgcgaatgagggcaacgggatagggagcgcggacaggggatcgttgggcccaacaaaaggcgggaggggacccaagaacacgggatcaagttatccgtggaaaaggaaggtggactggaagaaccagagaatccgccggaattcggccaacccgccaggggaactcaattagtaaggaagccgcaagcgggcaggatgaaaaggggtgtaaccacctccgttgggaatccgggtttcccggggaagtgaaataccgcttgggaagcacgggtgtccaaccctgggtggacaatagggtgcccggttttgaacaccctcgaccatactccggtaagatatagaactacccggggtgtattcttctacaaaatgagcgcgaggcaaaacgaagaaatttcgggtgcgagcatccaaggacaagggtggacaagtccggttatcaggggaagtgtgggggatactcccgcgtttcgcccnccatatcttcaagaaagatctccataggaaccgctttggtagccaccgtcggaatagcgtgaggatttctcccctctttgataaggatctcttcagcgttcatgagatgtagccaaacctctgccggggaaggtttgggtgtttttatgaacccataatctaatcgtggcgagaaacacaatggggctctg

SEQ ID NO: 88634 - DNA, 759 bp, Zea mays
  misc_feature: Ceres CLONE 1576022
  misc_feature: Encodes the peptide sequence at SEQ ID NO. 88635
ctggagctccccgcggtggcggccgctctagaactagtggatcccccgggctgcaggaattcgtctcacccctagaaaaaatgggaatgatggggatggggatgggaggctacggcctcggtggccccatggggatggggggctacggcctcggaggtcccatggggatggggggctacggcctaggcggcgaggacgacgacgatgccatgaaggacctacacgccggcgccggagcaggggcaggggacgatcctcccgcggagttgaaggtgggagaggagagagagatcgggaaggaagggctgaagaaaaagctggtgaaggagggcgagggatgtgaccgccccggcgccggcgacgaagtcgaagttcactacacggggacgttgatagacggcaccatgttcgactccaccagggaccgcgactccccgttcaagttcacgctgggccaaggacaagttataaagggatgggatttgggcatcaagaccatgaaaaaaggcgaaaatgctgtgttcaccatcccaccagagcttgcatatggtgaagatggctcaccaccagtcatccctccaaatgccacactgcaatttgatgttgagcttcggtaatgggtgtgtatcagggacatttccaacgatcggaggcttcttagaaaacgtgatagcccagaggccaataactgggagaacccccgaaaattcctcgaggaaagtggttggttaaggtttaaaccaaggcgtggggggatgg

SEQ ID NO: 88635 - protein, 178 aa, Zea mays
  misc_feature: Ceres CLONE 1576022
  misc_feature (85)..(178): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGMMGMGMGGYGLGGPMGMGGYGLGGPMGMGGYGLGGEDDDDAMKDLHAGAGAGAGDDPPAELKVGEEREIGKEGLKKKLVKEGEGCDRPGAGDEVEVHYTGTLIDGTMFDSTRDRDSPFKFTLGQGQVIKGWDLGIKTMKKGENAVFTIPPELAYGEDGSPPVIPPNATLQFDVELR

SEQ ID NO: 88636 - DNA, 919 bp, Zea mays
  misc_feature: Ceres CLONE 1576023
  misc_feature: Encodes the peptide sequence at SEQ ID NO. 88637
ctggagctccccgcggtggcggccgctctagaactagtggatcccccgggctgcaggaattcgtctcacccctagaaaaaatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagatttacctgcttgtacgcgcggtcgacgagccatcagcgaagcagcgcgtccaacaagaggtgatagacacggagctgttcggcctgctgagagagaaacacggcaagggcttccagcagttcgtagaggccaaggtcgtcgctttggccggagacatcgtatacgacggcctggggctggaggcagccgtgctggacgcgctggccaaggacgtcgacgtcatcgtcaacatcgcagcaaccaccaacttctacgaaagatacgatgtttcgctggacgtgaacgtgctgggagtgaagcacctgtgcatgttcgccaagcagtgcgcgaggctcaggatgctcatgcacgtctccactgccttcgtctcgggcttcagggaggggctcatctggagagcccatcaagccggcgagtcgctgccggaaggcacgtacctgacgtggacgcgagctgcgctcctcagggaggggaagagtcgctggcgcgaacggcgaccgtgacggcaacgcccggacggaaggcctaaaggactgggcctccgcgggccgggacttcggggggccaaaccgt

SEQ ID NO: 88637 - protein, 210 aa, Zea mays
  misc_feature: Ceres CLONE 1576023
  misc_feature (19)..(210): Pfam Name: NAD_binding_4 Pfam Description: Male sterility protein
MMMDAARIVEYFKGKCILVTGSTGFLGKILVEKILRVQPDVRKIYLLVRAVDEPSAKQRVQQEVIDTELFGLLREKHGKGFQQFVEAKVVALAGDIVYDGLGLEAAVLDALAKDVDVIVNIAATTNFYERYDVSLDVNVLGVKHLCMFAKQCARLRMLMHVSTAFVSGFREGLIWRAHQAGESLPEGTYLTWTRAALLREGKSRWRERRP

SEQ ID NO: 88638 - DNA, 918 bp, Zea mays
  misc_feature: Ceres CLONE 1576024
  misc_feature: Encodes the peptide sequence at SEQ ID NO. 88639
  misc_feature (918)..(918): n is a, c, t, g, unknown, or other
gctcttgaactagtggatcccccgggctgcaggaattcgtctcacccctagaaaaaaaaagctaggtgcttcggcttcctttcgcgcccaattggaggcacaccccgcaataaaaaaaaatgagaattcgatgcgacaaacaagctcaaatgcttggtcggtccttttgaaggttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttaccgcggcaggcgcggcggtggccggcggcggcgcccaaacctctgcgccagtgagtctcggcggggacgcggcggggcggatgttcgcgccgctggtcgccgccgagcccgacccggccgctaccggggagccggttgccgtgcaagcgctggggcttgcagtgctttcctgaaactctgctgcaagccctgatttttcagatgcttctgaaatcatatccggggtcaaggcaggtcgtgtttcacagggccactcccctttggtgggcgcccgtttgcggaccctcagcggggcttgccctaccctctggaatttttaaatggtcaaggttcggccaacctggttcccccctgggtcccgggggctgcaaccctttggaaggcccccttaatttgtgcaaaacagggccctgtcccgggggggaatcctggggtgaaaacccggggggtggtaaccttcctgcgcacgctgggtctcacacgacgagatattctttccaaagggttctcttttttagggctccccggaaaacccgatatcccgccgcgactttattttttgggaaaatcacaatccccccn

SEQ ID NO: 88639 - protein, 30 aa, Zea mays
  misc_feature: Ceres CLONE 1576024
MFAPLVAAEPDPAATGEPVAVQALGLAVLS

SEQ ID NO: 88640 - DNA, 1203 bp, Zea mays
  misc_feature: Ceres CLONE 1576027
  misc_feature: SWISSPROT Homolog: EC 3.4.16.5 Carboxypeptidase C
  misc_feature (11)..(11): n is a, c, t, g, unknown, or other
  misc_feature (18)..(18): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (119)..(119): n is a, c, t, g, unknown, or other
  misc_feature (120)..(120): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (144)..(144): n is a, c, t, g, unknown, or other
gagaaggacgntaaaggnaagaggagtgggggtnnnnnntttnnnttnnnnnntnnttttttnnntnttnnnnnntnntttttttttttggatgagaaagagaaaaagaaaaagaaggnngggnnnnaaaactggaactcaccncggtggcggccgctctagaatagtggatcccccgggctgcaggaattcgtctcacccctagaaaaaatggttggtggcttggtgccctgccagctagtgcttcttcatcctttctctaacgagtgagggacgatgatgcactcccagtcgcaggctcccactcccaccttgcggtgctgccgcactctagctgagctgccagctcggatctccatggcctctcttttcctcctcctcctcgtcgtcgtggcggcgctcctctggccgcctgccgtcgcggcgcccgaggagcacctcgtcaccggtctcccgggcttccatggcgccttcccctccaagcactactccaggtacgtgaccgtggacgagcgcagcgagcggagccctcccctactacactggtgctgtacggagcgcgaacccggtccggcggaccccgatcgtggatctgggctcaacaggaggctcccggggatggctccaagaatttcgaacaggctttcagttctatcgggggaaaacgggaaccgctgtcaaaatttttcgaaagcccctggggggaagctttccgcccctgggaaaaggcccctggtcccccaaaaggccttggcaaaggccttcaaaaacccccccctaacacaaaggcctggggttcccaaaaaaaggggttcctttccgggaaaccaaattccatgtggggttacccccttaaggaaaaattccttccccatggacccccggttttattggggggggaaattagtctcgggtaaccttcggcccttggaaaacaaaaaaattccggggaattttaattgttaaacacaggggttggaaactcctgaaaaaaaaccccggcagagcctttgaacacgcccccaaacaaaaaaatttcccaattttcccaaaaaattggtgttcccaaagttttgtaaacccccccggaagtttttacagggttgaaaaaccccggtttcctaaaaattcaatcggggggggaaattccgttaacagccaagagggattctaacattctccgccccgaaatctccctgaaag

SEQ ID NO: 88641 - DNA, 869 bp, Zea mays
  misc_feature: Ceres CLONE 1576034
  misc_feature: Encodes the peptide sequence at SEQ ID NO. 88642
  misc_feature (266)..(266): n is a, c, t, g, unknown, or other
  misc_feature (267)..(267): n is a, c, t, g, unknown, or other
  misc_feature (278)..(278): n is a, c, t, g, unknown, or other
gcggtggcggccgctctagaactagtggatcccccgggctgcaggaattcgtctcacccctagaaaaagagttcgaggcgacaggcatcgtcgtcccacccagcagtgcagagactctctctccctccctctccccggccacctctcgctcacgagcaccccatcttcccggccagggcctgggtatgggtgctccgctcgcctcctggccatgggcaagcctcggatcatacaagtacctgctgtacgggcctctgggtgcgaanngtgcgcacgcntggagggagacggggagcctgccgctggggtcgtggtgcctccaccctctgctccctctgggcttcgctcgctcaccttcaggtctgggtctcctaggcaacatgttcttctttacccggcggcggccgcgtcgtcaaggaacgggttcaacttccccccaattaaaccccaattgggactggggaaaaaatgggggaccctgcaaacccttgttcccggggggggggcaataggaaaaccccgggttttccccggccctttttcaaaactttcgggcgcttgggaaccccccccggggtgggggccccggggccttttttccctggcccggggggcgccctctttaaaaaccccccctctttttatgggggccccaaaggggggcttttccccgcggggggcccccctttttttacccagaaaacccccccggggggaccccctttgttctcccccccctaaaaaaaggggtttttttttagggggggtgttttccccccccccccctgtgagggggcgggttttccctctaaaaaatttggaaaaaaggggggggcccccccctctggggggggggggtttcttttttg

SEQ ID NO: 88642 - protein, 108 aa, Zea mays
  misc_feature: Ceres CLONE 1576034
  misc_feature (27)..(27): Xaa is any aa, unknown, or other
  misc_feature (28)..(28): Xaa is any aa, unknown, or other
MGAPLASWPWASLGSYKYLLYGPLGAXXAHAWRETGSLPLGSWCLHPLLPLGFARSPSGLGLLGNMFFFTRRRPRRQGTGSTSPQLNPNWDWGKNGGPCKPLFPGGGQ

SEQ ID NO: 88643 - DNA, 853 bp, Zea mays
  misc_feature: Ceres CLONE 1576035
  misc_feature: Encodes the peptide sequence at SEQ ID NO. 88644
  misc_feature (768)..(768): n is a, c, t, g, unknown, or other
  misc_feature (769)..(769): n is a, c, t, g, unknown, or other
  misc_feature (777)..(777): n is a, c, t, g, unknown, or other
  misc_feature (825)..(825): n is a, c, t, g, unknown, or other
ctccccgcggtggcggccgctctagaactagtggatcccccgggctgcaggaattcgtctcacccctagaaaaaccccccccttttcttgcattgccgttgttgtttgttatcacagcagccagtagcagctcaattagcaccaccgaccccggcggcaatcctggccggcatggcttccacgtcgaacttcctggccgtggcgctggtcatgggcgccgtgcttctcggcggcgccggcacgtgccacgcggcccgccggctcgacgaattgccgccgctgcctcaagtcccagcaggtattccgagtctgccggcgccccaagtgcccgagctgccgatgcctcaagtgccgacggtgcctcaactgccgggcgtgccgctgccgcccgccgcggtgccgtaggtgcgctgatttggtcgcgggtggatcggagggaattgatggagaaattagttcatttctctctcaatttccttcaatgcttccgtgattctcttgtcatcaaattaactctgatggtgtatcgttcccccgtgccgccctctctttgtaccgccgccgccgcgtcttcaccgaccaccgacgagcctagagacgtgcaaatgctgcctggcacacgggtgctgccgccaacgccctgtcatgtacctgtgtttatgtacgggtatttttgtctgttgtaccattgtattttctcctgcgacgaaattaattaaatatgctcattactacagcttaaaaaaaaaaagggccctggagataacnntcgcacgncagcaacgcacgcggccaggcccaatgtgcgaagaacaaggacgacgncgggcgcacgcagcaagcagctcttgac

SEQ ID NO: 88644 - protein, 77 aa, Zea mays
  misc_feature: Ceres CLONE 1576035
MASTSNFLAVALVMGAVLLGGAGTCHAARRLDELPPLPQVPAGIPSLPAPQVPELPMPQVPTVPQLPGVPLPPAAVP

SEQ ID NO: 88645 - DNA, 867 bp, Zea mays
  misc_feature: Ceres CLONE 1576038
  misc_feature: Encodes the peptide sequence at SEQ ID NO. 88646
ggagctccccgcggtggcggccgctctagaactagtggatcccccgggctgcaggaattcgtctcacccctagaaaaaatcagccatcccctcccgcggcaagtctctctgaattgtgggtatccggcgatggcggctctagctccatccaagattctgggcacaaagctcaacttcgccggctcctcccgctacaccacggcagcgcccaccgcgggggctcagaagatcgtctccctcttcagcaagaagcctgcccagaagcccaagccctctgcggtgtcgtcctcttctccagacatcaacgacgagctcgccaagtggtacggtcctgacaggaggatctacctgcctgatgggctcttggaccgctcggaggtaccggagtacctcatcggagacgtccctggagactatggctacgaccatgatggcctgggcaacaagcagaggacttcgacaagtacagggctacaagctgatcatgccacatgggccatgctcggtggcgatgggcatgtcatcccacacgcgtgcaacaagttcgggctaactgcagccccccagggcggctgggtcaaaaccgggccctgctccggaacggaaccccctctctaattgcggaaaggaatccccaataaactgggggtcccctgaataccgaaagggggtcccccttggggggccccaaaaaaaaacgggaaacttccaggggattgggacctcccgggaaaaagcgcccccccccgaggcccccttaaaagcccccctcgttttggggaggggcctccccagaaggggagccccgatttcctaaggggggaaggggaaaaaagaaaaagagcccgccgcttctcccaaagtatc

SEQ ID NO: 88646 - protein, 162 aa, Zea mays
  misc_feature: Ceres CLONE 1576038
MAALAPSKILGTKLNFAGSSRYTTAAPTAGAQKIVSLFSKKPAQKPKPSAVSSSSPDINDELAKWYGPDRRIYLPDGLLDRSEVPEYLIGDVPGDYGYDHDGLGNKQRTSTSTGLQADHATWAMLGGDGHVIPHACNKFGLTAAPQGGWVKTGPCSGTEPPL

SEQ ID NO: 88647 - DNA, 966 bp, Zea mays
  misc_feature: Ceres CLONE 1576040
  misc_feature: Encodes the peptide sequence at SEQ ID NO. 88648
  misc_feature (747)..(747): n is a, c, t, g, unknown, or other
  misc_feature (796)..(796): n is a, c, t, g, unknown, or other
  misc_feature (940)..(940): n is a, c, t, g, unknown, or other
ctggagctccccgcggtggcggccgctctagaactagtggatcccccgggctgcaggaattcgtctcacccctagaaaaaagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaggaggagaggccgaggcagggagagggttccggcggcgatggagcggtacaacccctccgaggtgtacgagctcttcgtgcgccacatgaacaacccgagggtggtggtggacaacggcgcgtgcgcgacggcgacgctggtgcaggtgcacagcgcgaggaagcacggcgtgctgctcgacgcggtggcggccctgtccgaccacggcgtctgcgtccgcaaaggctacatctcctccgacgacggccgctggttcatggacgtcttccacgtcgtcgacgccgcgggcggcaaggtggccgacgccggcgccctgctggcgcgcctcgagtcctcgctctccgccgacgcattggcgccccgccccgcgcccgccgncgcgggggccgggacgcccaccctgctcgagctcgtcgggcgcgtacgnccggggctttcctctcgagggtctcgcggtgctgcacgacctccgctgcggcaccgtcgacgccaggggctgtaccaacgcgggcgcgtcgccgcgctcgtggtcgtgcgcgacgaaagaacggctcgcgatctacaaccgggncggttcagcccgtggagtcaggctcc

SEQ ID NO: 88648 - protein, 186 aa, Zea mays
  misc_feature: Ceres CLONE 1576040
  misc_feature (114)..(114): Xaa is any aa, unknown, or other
MERYNPSEVYELFVRHMNNPRVVVDNGACATATLVQVHSARKHGVLLDAVAALSDHGVCVRKGYISSDDGRWFMDVFHVVDAAGGKVADAGALLARLESSLSADALAPRPAPAXAGAGTPTLLELVGRVRPGLSSRGSRGAARPPLRHRRRQGLYQRGRVAALVVVRDERTARDLQPGRFSPWSQA

SEQ ID NO: 88649 - DNA, 861 bp, Zea mays
  misc_feature: Ceres CLONE 1576041
  misc_feature: Encodes the peptide sequence at SEQ ID NO. 88650
aaagctggagctccccgcggtggcggccgctctagaactagtggatcccccgggctgcaggaattcgtctcacccctagaaaaaacccatcactcgctatattcccattccaagtccccgctcttggattcccgacgacgagctcggagcttcttcttccctgctcggtgctcgccgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcagtgcaaagtgattaccttgcccatacctttttcttgaattgaatgtgtaatgctagtaggaatgtacatgttttgtttccatttcagcgctggaatggggtatgcaatgccattaaaatgaggaggggggatttatatttgtggaaatgattgatctggcttgcacaattaattcggtgtgctgatcggaccgaacctgttaaatatcagtttttcacattctgtttgggaactgttgccattagttcggatgttgtgttctgcgatgtggatctgacacatgttaaaaaggaaaactttaagttgccctggttttaagttgtttttcgaatccatttagggaagggggtgccatatattttgttgttatagtgtcgcatgatgtcaacctgacagacatgctccattcagcacactaatcaaatg

SEQ ID NO: 88650 - protein, 84 aa, Zea mays
  misc_feature: Ceres CLONE 1576041
MSAANQLAALVSNMYATGLLDDQFQQLQLLQDPSAPDFVSEVVTLFCQDGERIIEELAKLLEKPNVDFDRVDAFVHQLKGSSAK

SEQ ID NO: 88651 - DNA, 836 bp, Zea mays
  misc_feature: Ceres CLONE 1576044
  misc_feature: Encodes the peptide sequence at SEQ ID NO. 88652
  misc_feature (658)..(658): n is a, c, t, g, unknown, or other
ctggagctccccgcggtggcggccgctctagaactagtggatcccccgggctgcaggaattcgtctcacccctagaaaaaacggccacgccccaccctcactccccttctgcccttcgcccgcatacacattgccccgcaagctaccggcgaacgcctagcatctgtggcgccgcgccgcgccgcctccgcctccgctgatggggatgaacaagtcacggtggtgtcgcgccaccctgctgctgctcctgtcccttgctctccgcggcgcggcgttcctgcaggagcggaagaactacatcgtgcacctccggccccgggaagccgccgacggctccgtcgacgagtggcaccgctcgttcctgcagcaggcggcggcagggctggactccgcggccgacgacggcccgcagatcatatactcctatagcgacgtcttcaccggcttcgccgcgcggctcacggacgccgaagcagaggcgctgagggccacggacgggtgcgtgcggctgtacccggaggtgttcctgccgctcgccaccacccgctcgccgggcttcctcggcctccacctggggaacgagggcttctggagccgctccggattcgggcgcggggtgggtgattgggatcctggacacggggatcctgcccagccnaccgtccttcggcgacgacgggctccagcccgcgccaaggggtgggaggggacctgcgagttcagagcatcgccgggggcgatggcacacaagatcatcgggtcgcgcgcgttcggaaacccggcgttgacttctatgggccgccggtcacaaaccggggcacggaacgcaaacggca

SEQ ID NO: 88652 - protein, 212 aa, Zea mays
  misc_feature: Ceres CLONE 1576044
  misc_feature (31)..(113): Pfam Name: Subtilisin_N Pfam Description: Subtilisin N-terminal Region
  misc_feature: SWISSPROT Homolog: EC 3.4.21.25 Cucumisin
MGMNKSRWCRATLLLLLSLALRGAAFLQERKNYIVHLRPREAADGSVDEWHRSFLQQAAAGLDSAADDGPQIIYSYSDVFTGFAARLTDAEAEALRATDGCVRLYPEVFLPLATTRSPGFLGLHLGNEGFWSRSGFGRGVGDWDPGHGDPAQPTVLRRRRAPARAKGWEGTCEFRASPGAMAHKIIGSRAFGNPALTSMGRRSQTGARNANG

SEQ ID NO: 88653 - DNA, 823 bp, Zea mays
  misc_feature: Ceres CLONE 1576046
  misc_feature: Encodes the peptide sequence at SEQ ID NO. 88654
  misc_feature (466)..(466): n is a, c, t, g, unknown, or other
  misc_feature (467)..(467): n is a, c, t, g, unknown, or other
  misc_feature (477)..(477): n is a, c, t, g, unknown, or other
  misc_feature (507)..(507): n is a, c, t, g, unknown, or other
  misc_feature (539)..(539): n is a, c, t, g, unknown, or other
  misc_feature (570)..(570): n is a, c, t, g, unknown, or other
ccccgcggtggcggccgctctagaactagtggatcccccgggctgcaggaattcgtctcacccctagaaaaaaaatcccgtgtgctggcgtgctcgagcccacatcccaaccatatacgagacgagccgacgttcccccgggcccccaaggaaaaccatgtgctgtgcccgccaggtgccactaaatcggtagcgcatgctagcactgagacggagctcccagtaacggcaacaacaagcagcagcagccagacagccagtagtaacacagtaaccggcagaggccatggcgagatcaaggcaggaaggggaggccggaggagaggagcggaagctggtcctgggcaagtacgagctgggccgcctgctggggcagggcaccttcgccaaggtgtactacgcgcgggacctgagcgccgccgccggcacgggcagcaccagcgtggccatcaaggtgatcgacaanngcgcgctgcngcgcatggaggggatggttgagcacctgcnccgggagatctccatcatgccgatggtgcggnaccccaacgtggtgggcatccggggaagtgntcgccaagcggttcccgcgttttctgggtcatggaataaccccccgggggggaaccttttccccaagggggccccggggccccctcccccaagaaaaacgggggggggttatttcaaaaaattttgtgggcccccttgggttttttcaccccccccggggtttcccccccgggggacctaaacccccaaaaaccgtttttttcaaagggggaaagcgcgggtaaaagggaccaaaattttgggggcgcgcgcc

SEQ ID NO: 88654 - protein, 154 aa, Zea mays
  misc_feature: Ceres CLONE 1576046
  misc_feature: SWISSPROT Homolog: EC 2.7.11.1 Non-specific serine/threonine protein kinase
  misc_feature (60)..(60): Xaa is any aa, unknown, or other
  misc_feature (61)..(61): Xaa is any aa, unknown, or other
  misc_feature (64)..(64): Xaa is any aa, unknown, or other
  misc_feature (74)..(74): Xaa is any aa, unknown, or other
  misc_feature (85)..(85): Xaa is any aa, unknown, or other
  misc_feature (95)..(95): Xaa is any aa, unknown, or other
MARSRQEGEAGGEERKLVLGKYELGRLLGQGTFAKVYYARDLSAAAGTGSTSVAIKVIDXXALXRMEGMVEHLXREISIMPMVRXPNVVGIRGSXRQAVPAFSGSWNNPPGGNLFPKGAPGPPPPRKTGGGYFKKFCGPPWVFSPPPGFPPRGT

SEQ ID NO: 88655 - DNA, 827 bp, Zea mays
  misc_feature: Ceres CLONE 1576047
  misc_feature: Encodes the peptide sequence at SEQ ID NO. 88656
  misc_feature (810)..(810): n is a, c, t, g, unknown, or other
ctggagctcaccgcggtggcggccgctctagaactagtggatcccccgggctgcaggaattcgtctcaccccctagaaaaaacctcaattccacaccccgcggcgaggccgcggggcgcccacgcccaaacgccaaaaccctagctccccacccacccacccaccccaagcaccgcggggccgccgcgcgctcgcccacggtcgccacggatgcgcgcggcccgctcgcggacctcgacgacgccccgctcgcgtgccgcggctgttccgccatggacgagcccgagaaagtgaggggcagggaggatgcggcgtcgggccgcgaggctggcggcgccgaggaggccggggatgggttccagctcgtgatccatggcaagaagaagaagagggcggccagcggccaagactgcgggactgtgcgggcgttgaccagggagaagggagccgcgccggcgccgggggccaaggccaaggtgcctttccacgatccaagcattccccggccgcaggacgtatacaaaatcagagtggataactacaagccattcgagcatgtctggctggagcgcagcgaagacggcacccgacgtgttcacccgctggaaaacctgcctgttgaacagttcgttgacagaaatgttcctgacagagaaccagtgaagccagctgatttagaggatacaccatttacgctggttcaagatcacaaaggcttaacagaattagctaagaagttgaagagcgtaactgaatttgctgtagatctggagcataatcaatataggtcatttcagggcttgacctgcntgatgcagatttcacag

SEQ ID NO: 88656 - protein, 185 aa, Zea mays
  misc_feature: Ceres CLONE 1576047
  misc_feature (180)..(180): Xaa is any aa, unknown, or other
MDEPEKVRGREDAASGREAGGAEEAGDGFQLVIHGKKKKRAASGQDCGTVRALTREKGAAPAPGAKAKVPFHDPSIPRPQDVYKIRVDNYKPFEHVWLERSEDGTRRVHPLENLPVEQFVDRNVPDREPVKPADLEDTPFTLVQDHKGLTELAKKLKSVTEFAVDLEHNQYRSFQGLTCXMQISQ

SEQ ID NO: 88657 - DNA, 966 bp, Zea mays
  misc_feature: Ceres CLONE 1576050
  misc_feature: Encodes the peptide sequence at SEQ ID NO. 88658
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
nnggggntttgggttttacccaaattattaacacatatgacgcacgaacgaaataagagagaagggnnnnnngaagctgggactcccctcggtggcggccgctctagaatagtggatcccccgggctgcaggaattcgtctcacccctagaaaaaaaaaactctgtggatgacaccattcttattgattgctcaagtgagaatgttgaaatggagaaggcaggaaacgtcacacgtgagatgcctgagaaccaagctgcattggatgaggatgttggtaaaccgaatgaagtggttatcggtgacaagccccaagacacagtgacagataaagttgttcaggagggaagggaagtactgataactgatgagatgcagcaggggacagctggaatgcatgatgagatcgaggatgatcagtttgaatctgtttttgttcaagctgatcaagtagtcactgctgacaacctgctggaaccccccacagatcgtgaaattactgtggaggagaacacagcactgatagttggtgagagacaacagagcacggttacaatggatgaggatgttgtagaggaccattctgatactgatggtgatcattccaatgaacacatagaagcggtaactactgtcaaaattccagaactcaagctgattgaagatatttttgttcaatctgatcatgcagttgctgctgacaacctacccagaacaaggggggagattgtggtaattaccatggaagacccacatccctgattagtttgatgaggaagccaacaaaactcatggtttaacaggtggaatgggaagatcctctggccactgggattggtcttctggaaaacaccgattgaatggttgtcattcccctgaatttataaacaaaaatgtggaaatcttggattaaacttgtgctctgaaaaaaaaagttggccttggggaaagggaaacaacactcgga

SEQ ID NO: 88658 - protein, 183 aa, Zea mays
  misc_feature: Ceres CLONE 1576050
MEKAGNVTREMPENQAALDEDVGKPNEVVIGDKPQDTVTDKVVQEGREVLITDEMQQGTAGMHDEIEDDQFESVFVQADQVVTADNLLEPPTDREITVEENTALIVGERQQSTVTMDEDVVEDHSDTDGDHSNEHIEAVTTVKIPELKLIEDIFVQSDHAVAADNLPRTRGEIVVITMEDPHP

SEQ ID NO: 88659 - DNA, 1103 bp, Zea mays
  misc_feature: Ceres CLONE 1576052
  misc_feature: Encodes the peptide sequence at SEQ ID NO. 88660
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (31)..(31): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (70)..(70): n is a, c, t, g, unknown, or other
  misc_feature (74)..(74): n is a, c, t, g, unknown, or other
  misc_feature (76)..(76): n is a, c, t, g, unknown, or other
ttttttttttttttttttnnanttctttcgnggttgctagactttttgttctttggtggtcggnnnaagntttntntttttaaaactgggactccccgcggtggcggccgctctagaactagtggatcccccgggctgcaggaattcgtctcacccctagaaaaagaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcaagtgaagcctcctgtccagagtggataatcaagtttgtgggccccttcaaagggtcattttcttgggcccctgggtgaagaaggccaaatggatttgttggtcccaggcaccaaggggggtgaaagggaaaaaaaccaggttttttgccaagctttggaaaggaaaaatcctccccccccctaaatgggggttcccctttattcccaaaaaataagggcccgtgtgtcaaataatttcggcgcccgagaaaaaacaccttttaaacccccgtttgggggggtgaaggcccccccgcataatctccaaaaaaaaatagggtccttgtgttggggtacacacccacgagtgtccccccgggcgccccgcagccctttctcaaaatgtggaacccccccaccgggaaggggccgtgggggcccaccaaaaaagaggaaattcccccgcggaggggggaaaattgcgctgggggccactttataaatgggaggccccgccgggttttctcttctggatgcgggggcccacaacaagagtggggcaggttatatattacccccatatatggggtctcttagaaaaaataaaaggcgctcaccacagagagtgtgcgtggg

SEQ ID NO: 88660 - protein, 82 aa, Zea mays
  misc_feature: Ceres CLONE 1576052
MAGKGDGPAIGIDLGTTYSCVGVWQHDRVEIIANDQGNRTTPSYVAFTDSERLIGDAAKNQVAMNPINTVFDAKRLIGRRFK

SEQ ID NO: 88661 - DNA, 1276 bp, Zea mays
  misc_feature: Ceres CLONE 1576053
  misc_feature: Encodes the peptide sequence at SEQ ID NO. 88662
  misc_feature (1)..(1): n is a, c, t, g, unknown, or other
  misc_feature (29)..(29): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (923)..(923): n is a, c, t, g, unknown, or other
  misc_feature (1056)..(1056): n is a, c, t, g, unknown, or other
  misc_feature (1109)..(1109): n is a, c, t, g, unknown, or other
  misc_feature (1229)..(1229): n is a, c, t, g, unknown, or other
ntttccgcctccatagccacctatatttnagacaatcgaaataccctccggccnnngccnnaaaaaaannnaaaaactggaactcaccgcggtggcggccgctctagaactagtggatcccccgggctgcaggaattcgtctcacccctagaaaaatttttccgctcggcacctccccatctacggatctaccgagcatcgaaggcacacgatccaaatatgccttcggcgccgctcgtcgcggctgccatcggcacgcgcgtcagcctccgcccgaacctctcactcctcgccgatcgttgcgctacaccttgcgccctagcccgcgtgcacgccgccatgctcgtctccggccgcctcgccgaggacgctttcgccgcgtcgcggctcctggacgcctacgtcgagctctctccggatcccgctgccgccgcactcggcgctcctctcctccctcccctgcgcgcccaactccttcatgttcaacaccacgctccgcgtgctccgcttcctccccgggacccggccaccaacattcccccttctttctcccgccatcccacggccactgggaaccccttcttggccccggccgggcacaacatttccccctttcctccctggaagggccggccggcctcggccctttcccgtgttcttcttcatccccccggatcacccggaaaacaaagcttcccaaacggcggacattcgacaccggatcacggggggcaaagggaggtggtctccccacaccctctcgcaatgtgggccgcttaactagtgtcgcgggccgcaaaaaaagggcgcgacccactcggcatttatcttcggcgagcgccacccgagtaatatcaacacccggtggggaacaggaggggggacccttatatttgttactcccgaccccccccccagtgagnagagtgcataaagaggggggggtttttctatagaacacaaaaaggagtgggcccccccccacaacagccggagaaaatacccgccgcacacagacggtgtgatatcacacacctacaaccccaaggggtgggngctctaccccacccacagagatatcgaggccgcgccacaaaaatagagtgggngagagaggacacacgacatgacgaaaccacaccgccaatgggcgcgcggtggagcttttccacttcccaacagaaattggggtcctcctcactatgggggagtctctttttaagaacgcnacgcggagggtggagccctcccgccgatcttggggcctcgctgagag

SEQ ID NO: 88662 - protein, 186 aa, Zea mays
  misc_feature: Ceres CLONE 1576053
MPSAPLVAAAIGTRVSLRPNLSLLADRCATPCALARVHAAMLVSGRLAEDAFAASRLLDAYVELSPDPAAAALGAPLLPPLRAQLLHVQHHAPRAPLPPRDPATNIPPSFSRHPTATGNPFLAPAGHNISPFPPWKGRPASALSRVLLHPPGSPGKQSFPNGGHSTPDHGGQREVVSPHPLAMWAA

SEQ ID NO: 88663 - DNA, 973 bp, Zea mays
  misc_feature: Ceres CLONE 1576055
  misc_feature: Encodes the peptide sequence at SEQ ID NO. 88664
  misc_feature (17)..(17): n is a, c, t, g, unknown, or other
  misc_feature (18)..(18): n is a, c, t, g, unknown, or other
  misc_feature (38)..(38): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
gaggaggggaagagacnnataattgtttcaccagcganaacaagggggaannnnnnnnnnnnnnnaannnnaaaaaatggagctccccgcggtggcggccgctcttgaatagtggatcccccgggctgcaggaattcgtctcacccctagaaaaaaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacacccccaggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcgggcgatctgttactacggtggccccgtgggggaacaaagttcggctcctggtcgtcacgcggacgcgggtccccctcgcaggggggaagtgaccgtgtctgctgcccggcgaaacggcaacggcgaagggatcctggggggtccccggcattggccgaggcgaaaaaatcctcggaagaagggccattctcggtccgcttgattcctggtttcccccactggccaaaccccttacctaaattaaggaaacctgaaaggccggggggctttcccccccccctttgcgaacaattaattgggtt

SEQ ID NO: 88664 - protein, 244 aa, Zea mays
  misc_feature: Ceres CLONE 1576055
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNTPRIPVLVDEDDPLALESFLNITLVNKAGRSVSLKMDVSRAYFVAYVAGQRSCLLKRSGRTFSSGDLLLRWPRGGTKFGSWSSRGRGSPSQGGSDRVCCPAKRQRRRDPGGSPALAEAKKSSEEGPFSVRLIPGFPHWPNPLPKLRKPERPGGFPPPLCEQLIG

SEQ ID NO: 88665 - DNA, 1144 bp, Zea mays
  misc_feature: Ceres CLONE 1576057
  misc_feature (54)..(54): n is a, c, t, g, unknown, or other
  misc_feature (56)..(56): n is a, c, t, g, unknown, or other
  misc_feature (63)..(63): n is a, c, t, g, unknown, or other
  misc_feature (69)..(69): n is a, c, t, g, unknown, or other
  misc_feature (76)..(76): n is a, c, t, g, unknown, or other
gtgccgcgtgcggtaacggttccttctccaataagccgtaggtggaggtgagtntnctcacangtgggnttgggtnggttgggggtcaccgcggtggcggccgctctagaacagtggatcccccgggctgcaggaattcgtctcacccctagaaaaacctgccctcttccgccgcgtcgtcccctcctacgttcccctctccctcggtccgcctagatctcgccagggtttgccgcgtctcgtcttgatttttgctccggaaccagggctccatcggggcagagaggcaggaggggtaggccatcccggaaaagggcggatctgggtgttatcggaggaagagcatcgtgtagcgtttctgtcgggggcaggcatccacgaggtgtgatttaaaaagctttttggaatacggcatggactgcttcgggacttgtgacaacaccggaaccgatgaataatcttcccccaatcaatcaaaaaccgcaaaggcttggaaggggagggggacccctcccctgggaaaaaggaaaaaaataaggggtgggggccttcttcctgaaaaaccaaagaagttcccccccctcccaaccaaaactgggggaaaacccaaaatatacctttgaacccttttgaaccaaaaaaaggcgctttttttgggtccagggttttctttttgaggaccctttttccgagggggcgcccacaaaccgcaagattggctcatattaaaaagaccgggggggttaacacccccccccccggtggcgcccccccctctcgaaggtgggaaaaaattaaacattttttttttgttccccctcctcgggggggggccggcgcccacaaaattattttgcgcggggagaaccttttttttttcaaagggcggtttcttaaatccctccctctttttcttcccgcgggaaaaaaaaaaaaaaagaaacctctcccttcttctccgttagacccttgtggagaaaaaagaggctcctcccataattttttttttaatagagaaggagaaacacgcgggggggtgttctccttacacacaaaaaattaaagggcgggcgcattatattttattttcctccacaataaataggataatggcggcgatgacccccctcattgtgggtggttg

SEQ ID NO: 88666 - DNA, 1246 bp, Zea mays
  misc_feature: Ceres CLONE 1576062
  misc_feature (1)..(1): n is a, c, t, g, unknown, or other
  misc_feature (13)..(13): n is a, c, t, g, unknown, or other
  misc_feature (29)..(29): n is a, c, t, g, unknown, or other
  misc_feature (65)..(65): n is a, c, t, g, unknown, or other
  misc_feature (66)..(66): n is a, c, t, g, unknown, or other
  misc_feature (873)..(873): n is a, c, t, g, unknown, or other
  misc_feature (1207)..(1207): n is a, c, t, g, unknown, or other
nacgggggtgggntcccccctttaattanttcaggtgcttaatacgttaggtgagtggttgtctnngccagaggggggtccccgccgtggcggccgctctagactagtggatcccccgggctggaggaattcgtctcacccctagaaaaaaactgccctcttccgccgagtcgtcccctcctacgttcccctctccctaggtccgtctagatctcgccagggtgttgccgcgtctcgtcttgatttttgctctctaaccagggatccatctcggcatagagccaggaggggtaggccatccctgaaagtggcgcatcctgagggttttgggaggaaagagaatactgtagggtttctagagcgcgctggcgtccgatgaggagggagatagaaaggatttgtgactacagcggtggacctgggtcagacccggtagacagcgcagggaaccgtataatgatgctcctctgaatcgcatgcggaggcggggacacccacccaacaggcgggtggagcggcatttactggattaagggccaaaagattggccgtgggggtgactttctgtggggataactagaagggctcacggttcccgtaccatgcgactgtgaaagcaccagactaccgttgtaggctttggacccctaaggaggggagtaattggcgctccagccattttgcgtaaacaattttcgacaggcgcacacttctctcgatattctgaatagtacacaggggggggacccgtctcgctggggcgcttcggatatggtggggggcagcggaggtttgtggtgttgtggacggatctaaatgggcagcaatgtttggagaaacgttctcgtgtgtggagcgaacttcttgcgctgncgcgcgttctatgcggatcagtgcctcggataagattgtccgcggttgatgagatgagtggtggagctggcgccgcggttgatggcagatgacggtgttgggcacttggacgggtgctcgcattcgcgtagaggctctccgcggcggcggccggggagaggtacgtctattgggggcgacagagtggtgtcgtgatcagagaagataaggtgctgtatatctgcggcgcggagtaatattaatatagatgccaattttcttctacggtgagactcatggcggtcaccagacttggctggtatagcggcggaatgtcattccacgtgaggagggnagcccgtcgcgttgtgcggcccccactctgatgtggggt

SEQ ID NO: 88667 - DNA, 793 bp, Zea mays
  misc_feature: Ceres CLONE 1576069
  misc_feature: Encodes the peptide sequence at SEQ ID NO. 88668
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (58)..(58): n is a, c, t, g, unknown, or other
  misc_feature (336)..(336): n is a, c, t, g, unknown, or other
ctcacccgcggtggcgggccgctctagaactagtgggatcccccgngnngctgcaggnaattcgtctcacccctagaaaaaaccgtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgcccgcgcctcgagcaaggaggagccggcaccggcgtccccgcacggcgcgggcagctgggagctgggagcggtcctggccgactcgtcgtcgcccgtcttgcngcggggcctgggaaggcgccccgcctggaactgcccctgctgctgctgtggggcctcccggcggggggcgtctacccggaacaacttctcctgggccttgcccacccaaacttttgggggggatttgggaaccttggatttccccccccggttctttggaaaaaccgggtttccaatcccccccccataggggctctttttgggggaaggggcacccccgggggaaaaaacttttggggggggggggtttttgggggcgccacaaaaaaacaaaatttgggggggggggttcccccccagggggacaaagggttggtttttaatagggaccccccccggggcccttttaaaaggggggggggggaaccctttttttggggggaatacatttgtggtgtctccttgggggagaaaaaaaaaaaaaaaatttttttctggggggggcgccccccccgtt

SEQ ID NO: 88668 - protein, 112 aa, Zea mays
  misc_feature: Ceres CLONE 1576069
  misc_feature (50)..(50): Xaa is any aa, unknown, or other
MDSTTTTTAPLLQPAARASSKEEPAPASPHGAGSWELGAVLADSSSPVLXRGLGRRPAWNCPCCCCGASRRGASTRNNFSWALPTQTFGGDLGTLDFPPRFFGKTGFPIPPP

SEQ ID NO: 88669 - DNA, 882 bp, Zea mays
  misc_feature: Ceres CLONE 1576073
  misc_feature: Encodes the peptide sequence at SEQ ID NO. 88670
gagctccccgcggtggcggccgctctagaactagtggatcccccgggctgcaggaattcgtctcacccctagaaaaaatctccatctgcgtcgcgtcgctcgtgcttgacgcgcgccgagagcctaatcggatgcctccaggcatgcgccccgggcggtatcgatcctatggccacggcatgggctgaggggacgccgactcctgcagcgagccctgcgacgctcaggccacgttccacatccggtggaccaacgcctcctagttcaccgtgcgggtccaccagtgcgccaccctcggggagttttaggcgatcctcgcccacggctgcgacctgccggtgccgcagcaccgtctgatctacaagggccggatctttaacgacgaacagaccctctccacctaccgggtggagacagaccatacaatccacatggtacctggtgctgtgccatcaccaacatctactgcacctgcgaccaacctagaacctaccactgctgatcctgccggttcccgagctacatgattgggtggtttgtgacagaggctgggaactacaggcgctgctgctaactttgaggagttgggattagcatgcatctgccacccctggatagcatcaatgcctcgactgctggctgaatatccgagcttgctgagggacatgatgcatgtagcactcttgctggatatgatgaacaatcctgaactccatacggggcctagtaatgaacactccatcaatgcccgaggctatttgatggagatctgggatcttgctaattggtctttaaggatgcaagcggtagtgcccgcatactttctttatcaggatcgcattcttcaactccgcaggtgagatggatgcgggaataataccc

SEQ ID NO: 88670 - protein, 31 aa, Zea mays
  misc_feature: Ceres CLONE 1576073
MVPGAVPSPTSTAPATNLEPTTADPAGSRAT

SEQ ID NO: 88671 - DNA, 742 bp, Zea mays
  misc_feature: Ceres CLONE 1576074
gagctccccgcggtggcggccgctctagaatagtggatcccccgggctgcaggaattcgtctcacccctagaaaaagcagcgccggcgatccatcctccgctccctcccttactcgcgctcggcacgcaggcgacgccggcggtggtcaggctcgggctctaagcgacggcgtcagtgtcttcccctcccacctctcggcagtcgcctcgcgccctcgcctccggtcctccacgcaccagccggctactctgcgttcgtctctctctctctctctctcctaccacctccggtggatcatcaacgtcgctcggctgcgccgcgcgcggcctgtggacagctggagccagcagccgctgctccaccaaggcggtcgcgccgctttgggagcgcttgtgccccaaagcgaatcgttaaccgtcctatcagtgccggtttttgggaaccctgctagcgatgcacctttattacagtagctgacaccctctatcctgctgttacatattaggctgagctgattggccccattcaataaagaaagcgaaaggcatagataccagaagcaacactggagccctcctgcttgggaatcctatccgccgtgggaaacaacttacaccaagtttctggggaaaacttggctgatttctttttctggggggatcttgaataaaatggtcaaaacaaatgaagggcttcgcggtaaaaaaaaaatcccctaagccaaccgggtttaaggataaa

SEQ ID NO: 88672 - DNA, 796 bp, Zea mays
  misc_feature: Ceres CLONE 1576077
  misc_feature: Encodes the peptide sequence at SEQ ID NO. 88673
ggagctccccgcggtggcggccgctctagaactagtggatcccccgggctgcaggaattcgtctcacccctagaaaaagacgcccgcgacaaatccctgcgcgacggcatcttcgcctcccatcccctcccagcttcccctcccactccggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcgccgggcctcggccgtccgctgctcgctcgacagtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaggttggctcctttgttgacaggcaaggaaaccatatcgagatggggctgcatgtgttcttcgggtgctacagcaatctcttccgcctcatgaagaaggttggcgctgataataatctgctggtgaaggaacatacccatacttttgtaaataaagggggcacgattggtgaacttgatttttcggtcccggtggggagctcgttacatggcattcaagt

SEQ ID NO: 88673 - protein, 176 aa, Zea mays
  misc_feature: Ceres CLONE 1576077
  misc_feature: SWISSPROT Homolog: EC 1.14.99.30 Carotene 7,8-desaturase
MASVAATTTLAPALAPRRRARPGSGLLPPRRASAVRCSLDSNVSDMGVNAPKGLFPPEPEHYRGPKLKVAIIGAGLAGMSTAVELLDQGHEVDLYESRPFIGGKVGSFVDRQGNHIEMGLHVFFGCYSNLFRLMKKVGADNNLLVKEHTHTFVNKGGTIGELDFSVPVGSSLHGIQ

SEQ ID NO: 88674 - DNA, 856 bp, Zea mays
  misc_feature: Ceres CLONE 1576078
  misc_feature: Encodes the peptide sequence at SEQ ID NO. 88675
ggagctccccgcggtggcggccgctctagaactagtggatcccccgggctgcaggaattcgtctcacccctagaaaaaatctccatctgcgccgcgtcgctcgtgcttgacgcgcgccgagagcctaatcggagccaccaggcatgcgccccgggcggtatcgatcctatggccacggcatgggctgaggggacgccgactcgctgcggcgagccctcggacgctcaggccacgttccacatccggtgcaccaacgcctcctagttcaccgtgcgggtccacctgtgcgccaccctcggggagttttaggcgatcctcgcccacggctgcgacctgccggtgccgcagcagcggctgatctacaagggccggatcttgaacgacgaacaaaccctatccagctacggtgtggagacagaccatacaatccacatggtacgtggtgctgtgtcatcaccaacatctactgcacctgcaaccaaccaagaacctaccactgctgctcctgccagttccccggcaacatgattgggtggtttgttgcaaaggctgtgtactacaggcgcttctgctaacattgaggggttgggtttgtcttgatcttccccccctgggatagaccaaatgccacgcctgctggctgatattcgaacttgatgagggaaatgatgaatattccactcatgctgaagttgatgaccaatccctgactccaacgcgggacagtaatgaacaatcctcaaatgcgcgaggctattgaacgcaatccggatcttgctcatgtcctcaaagaatccagcggttattcccccgacctttttaaacaggtcggaattctttaactcctcaagggagg

SEQ ID NO: 88675 - protein, 31 aa, Zea mays
  misc_feature: Ceres CLONE 1576078
MVRGAVSSPTSTAPATNQEPTTAAPASSPAT

SEQ ID NO: 88676 - DNA, 1235 bp, Zea mays
  misc_feature: Ceres CLONE 1576079
  misc_feature: Encodes the peptide sequence at SEQ ID NO. 88677
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (67)..(67): n is a, c, t, g, unknown, or other
  misc_feature (87)..(87): n is a, c, t, g, unknown, or other
  misc_feature (1235)..(1235): n is a, c, t, g, unknown, or other
tggggggggtgnnnnnnnngggaggaagagggaggnnngnngngnggggggcnnncccccnngngcnccgggggggggggggggatncactcggtggcggccgctctagaatagtggatcccccgggctgcaggaattcgtctcacccctagaaaaaacgaccggaccccggtctagttatcgatcgaggggaacgaagcaagacaagagggagaccgaggaggcctagccgcctagggtagtcccgtccggtctcccgcggccagcgacagactgcctggcgccggcgaatcgatgggctactggtggcaccgcatcatgctgccagtgcggcgggcgtggctcggcgtcgcgtcccgcttacaggttcggcgaaccggtacggcacagcagcggctcgacacaggcgctctcatactaccctcccggggcggctactctgggtcgtctaactaacctcacaccgatcgaactcctttggcccaatctccttgcagggatggggggagagcggcggcaagggatgggtaaccaccctgcggaagtaccaagggaccgttgaccatgaatggtgggggaaaaacgctggaaacccgggggccctcgggagcggcccgggagggccccgggcagcccccaactttggggggcgggtgttgcccaccaaattctagtgtattccccgggtgcccgcggcaagtggcgcggcgaaagaccccgagacgggggctctctgtggggaggggggggggcacaccacagagggttttttccccgcccgcccctgtataaatagcacccgagaagaggagggcttgtccccctatgggttagtgggaaaacacaacagagtgaggcggtgaggcgcgctgcgtgggtgttcgtggatttggggagcactaaacatataccgcggggccaaagtgaaagattagtttgtgtgttgtggggcgctgccgccgcggtggtgatcatgggtgatgagccccgcccgggggcggagaaaagaggaaatatataaagggggcgcgcggctgaccaccaccctatacatagagttagaggatacgaggagcgcgggtgttgtggacgggggaggtgcgtttatactgcggggcttttcacgacatgggcggttgccgcccccgggtggagcggttgggtggatcggtgagtgcgtggcaataaccgtagtagtgtagtaatatattcggaaaggaacgcgtatccgccgn

SEQ ID NO: 88677 - protein, 53 aa, Zea mays
  misc_feature: Ceres CLONE 1576079
MGYWWHRIMLPVRRAWLGVASRLQVRRTGTAQQRLDTGALILPSRGGYSGSSN

SEQ ID NO: 88678 - DNA, 788 bp, Zea mays
  misc_feature: Ceres CLONE 1576080
  misc_feature: Encodes the peptide sequence at SEQ ID NO. 88679
ccccgcggtggcggccgctctagaactagtggatcccccgggctgcaggaattcgtctcacccctagaaaaaacgagggggcccacgcctgaatgccaggcgttgccgcgacttgtcgcgcctcgccctcccctactcggctactccactccactccactcgcccgcgcccgccgcccgcgtgctcctccctcgcgcccgccccgccccgctccgcccctatctatatccattcccgctcgtccccctcaacaaccctcctcaccgcgcactcgtgttcgtgtcatcccgcccgcaggccgcagtccatggccaccgccagcctcgcgctctcgctgcgcctcgcgccgtcctcgcgcccgctgagcctccgccgccggggggccgccggcgtcacctgccgcgccaccaccgccacgttccaccagctcgacgccgtcgcggtgagggaggaggagtccaggttccggacggcggcggcggagggccgcaacctgctgccgctcacgaggtgcatcttctccgatcacctcacgcccgtgctagcgtaccgctgtctcgttaaggaggacgaacgcgatgcgcccagctttctcttcgagtctgtcgagcaggggtccgagggcaccaatgtggggaagtacagcgtggtcggggcgcagccttctatggaggtcgtggccaaggctaaccatgtgacgggcatggaccatgaaatgaagtcgaggagggagcactttctggcctgatcccaggagggatccccaggacaatcatggaagaatggga

SEQ ID NO: 88679 - protein, 146 aa, Zea mays
  misc_feature: Ceres CLONE 1576080
  misc_feature: SWISSPROT Homolog: EC 4.1.3.27 Anthranilate synthase
MATASLALSLRLAPSSRPLSLRRRGAAGVTCRATTATFHQLDAVAVREEESRFRTAAAEGRNLLPLTRCIFSDHLTPVLAYRCLVKEDERDAPSFLFESVEQGSEGTNVGKYSVVGAQPSMEVVAKANHVTGMDHEMKSRREHFLA

SEQ ID NO: 88680 - DNA, 865 bp, Zea mays
  misc_feature: Ceres CLONE 1576083
  misc_feature: Encodes the peptide sequence at SEQ ID NO. 88681
  misc_feature (464)..(464): n is a, c, t, g, unknown, or other
  misc_feature (514)..(514): n is a, c, t, g, unknown, or other
ctccccgcggtggcggccgctctagaactagtggatcccccgggctgcaggaattcgtctcacccctagaaaaacttccgttgcgccggcccggataaggtaaggagaggataccttcactgctctgcggctgctccgccacgccgccgtccatcgtccatcgtccatggcgtcaccgcaccttcctttcctctccttccccaaaacattaccgccgctacctcccccactcaagacccacgcccaccgcacctccctagccgccgctcctgctccgccgcccgccccgcctgacggcgcggggcccgccgcgcccacgcgtggggaccgcttcctcggccgccagctgggcaccgagggccgcgcgcgcgtgctcgcgcccgaggacgccaacagcggcgccgacgcagggagaagcgcggggccttggcacggagccctccgggctcgcatcctgctacggntgcggcgcccccctgcaaaacggggaagaaggcgcgccgggaaacttcgnacccggaaccttaccaactggagaaaaggctttccccaactagaaccgttttttgttggaagggtgcaaccttcttttttatgggcacatgggtaacggtttttgggggcccccgggggtattccgggggggaaaaaatttttttttccgcaaacccttcgggaaaagtttttttaccccctcccaaaaaaaagcctcaaaaaaaaaatgggtgaaccctttaaaattaagggaaaattccgcgcgccgggaaccaaattttgggggggaaaacctttttaatttgggaaaaaagggggtgtttctcctcccaaaaaatttttttttttttttgccgaaccggggtttttc

SEQ ID NO: 88681 - protein, 147 aa, Zea mays
  misc_feature: Ceres CLONE 1576083
  misc_feature (100)..(100): Xaa is any aa, unknown, or other
MASPHLPFLSFPKTLPPLPPPLKTHAHRTSLAAAPAPPPAPPDGAGPAAPTRGDRFLGRQLGTEGRARVLAPEDANSGADAGRSAGPWHGALRARILLRXRRPPAKRGRRRAGKLRTRNLTNWRKGFPQLEPFFVGRVQPSFLWAHG

SEQ ID NO: 88682 - DNA, 829 bp, Zea mays
  misc_feature: Ceres CLONE 1576085
  misc_feature: Encodes the peptide sequence at SEQ ID NO. 88683
ctggagctcaccgcggtggcggccgctctagaactagtggatcccccgggctgcaggaattcgtctcacccctagaaaaagcctccctaaagatccgccgcttctctgccctctgctcgtcgattcggcgcctcctctccttcacgcgcccacgctgccgtcgcctcctcctcactgtcgtccatgccgctgtagccgcctacggccatggccgctggagccagcgactatttgacggtggagtaccactccagagagctcccctctttcctctccgacgacgagggagccaccgccggcagcggcgtcctcgtatgcagaacagcagaggacgctcgctcgctctgcgcgcatcgaaccaaaaaccacacctcggcggcagctatataaaagccttcacctgacccgggcgctagggtttattcgctcctcccacccgccgccgtcgccgcctcctctccccagcacccggagctcgctcgaccgccgctcaccatgatcatccccaagaagaaccgcaatgagatctgcaagtacctcttcaaggggatggtccactagactcgcagtagggtaacctgggctgattggttgtttcgccttctaggaggtgacagatcttcaaattatttttcgtattactagggaggggaggggctcgtgtattattttgggagttcactttttttgggtcccaattttcagcctcctcaccaagctttaacgaatcctgaaatttattaatagggcttcaaccacaggcaaaggcatttgggtaaatggaagccattcttttccccgaattggggaaagacctaattttcaaaag

SEQ ID NO: 88683 - protein, 60 aa, Zea mays
  misc_feature: Ceres CLONE 1576085
MAAGASDYLTVEYHSRELPSFLSDDEGATAGSGVLVCRTAEDARSLCAHRTKNHTSAAAI

SEQ ID NO: 88684 - DNA, 830 bp, Zea mays
  misc_feature: Ceres CLONE 1576086
  misc_feature: Encodes the peptide sequence at SEQ ID NO. 88685
ggagctccccgcggtggcggccgctctagaactagtggatcccccgggctgcaggaattcgtctcacccctagaaaaaaccccgacccgacccgtttccaggccatcacaccaccgcctcccccgtccccgcctcgccgccgccgccgtcgtggcctgccggcctccgatggcgaagacccgcatgcctgcgtccccaccccccgcagaaacgccgactccgcagcggcggcgcaagaagaagggccgcccgtccctcctcgacctccagcgccgcagcctccgcctccaggcccaaaaccctagccccgacccctcgcccacccgccgggagcccaaccccttcgacgacgatgaggacgggaccgggagcgggcggcggcgccagaagcgcttcaagagcgtcctatccggcgttgttaaggaggagctgggggagggggagaaggatgccgcgaaagcgacggggaaaggggacgctgcgtcggatggtgggcccgcggggactcccctcccagacaaaaagttgctactcttcatcctcgagagggtccggaagaaggatgcttatggagtgttctcgggagcctgtcgacgcgaaggagctgcccgagtactttggacattagtgggtcgtccgatggacttgctcaacgagccgtgagagagcggttgaatgggctccttattctaaagttgggaacgggtttgagggatgagggaattttctagccccccatcaaaatgcgcaaggtgcttaacaattcaagcaaaaaacaattcttactttcccgggcagggcagcgggtcccaatttgagaacctccttgt

SEQ ID NO: 88685 - protein, 164 aa, Zea mays
  misc_feature: Ceres CLONE 1576086
MAKTRMPASPPPAETPTPQRRRKKKGRPSLLDLQRRSLRLQAQNPSPDPSPTRREPNPFDDDEDGTGSGRRRQKRFKSVLSGVVKEELGEGEKDAAKATGKGDAASDGGPAGTPLPDKKLLLFILERVRKKDAYGVFSGACRREGAARVLWTLVGRPMDLLNEP

SEQ ID NO: 88686 - DNA, 845 bp, Zea mays
  misc_feature: Ceres CLONE 1576089
  misc_feature: Encodes the peptide sequence at SEQ ID NO. 88687
ctggagctccccgcggtggcggccgctctagaactagtggatcccccgggctgcgggagttcgtctcacccctagaaaaaagctcactcgtgccgtgcactcgacccgtccgccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctgaagatctccaacgccgactcggcgacggacgacgaccggagccgcgacctggaccgggcggcgctgatgcggcagctggacgagacgcagcagagctggctcctggccgggcccggcgaccaggccggcaagaagaagaagcggtacgtcgacctcggctgcgtcgtcgtcgaccgtaaggtcttcatgtggaccgtcggcaccatcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaagggcaactcctgcatgatagacggcctctccgacagcaccgttcgccgggagcctggtcggaggcttctacgaaccggggggacgccatcaaggtttcactacccccagggcatggtccaggaacctggcttcaacttggaaccggtgaatcaaattacagggggccaagttccaagt

SEQ ID NO: 88687 - protein, 197 aa, Zea mays
  misc_feature: Ceres CLONE 1576089
  misc_feature: SWISSPROT Homolog: EC 3.2.1.4 Cellulase
MFGRDPWGGPLKISNADSATDDDRSRDLDRAALMRQLDETQQSWLLAGPGDQAGKKKKRYVDLGCVVVDRKVFMWTVGTILGLGVFIGFVIMIVKLVPHKRPPPPPPDQYTQALHKALMFFNAQRSGPLPKHNGVSWKGNSCMIDGLSDSTVRREPGRRLLRTGGTPSRFHYPQGMVQEPGFNLEPVNQITGGQVPS

SEQ ID NO: 88688 - DNA, 826 bp, Zea mays
  misc_feature: Ceres CLONE 1576092
  misc_feature: Encodes the peptide sequence at SEQ ID NO. 88689
ccccgcggtggcggccgctctagaactagtggatcccccgggctgcaggaattcgtctcacccctagaaaaaaaccgtaagcaaaatggtgctacatccgacgtgccggacggggtgcgacgcgccgtgagttaccgaattacccctctatccgcctcccccctcttctaacaagtcgtcgcctcggcccggcttcgcctccctcggcgcgacgacctctcccccaggagagcctaccccctccctcattccccgcgcgacgaggccgcttaatggagggtcgcggccggcctcggccgggctcgctccaggctctcgtcgtcgccgccgccatcctcctcctggccgccgtgtccggggtcggcgctggatcccccgatcggcccgcgccggggccaccgctgttcctcccgctcacgcgctcgtaccccaacgccagccggctcgccgcctcgctgcggcgcggcctcggcgacggggtccaccccaacgcgcgcatgcgcctccacgacgatctcctcaccaacgggtactacacgacgaggctgtacatcgggacgcccccgcaggagttcgcgctgatcgttgactccgggagcaccgtcacctacgtgccctgctcctcctgcgagcagtgtggcaaccaccaggatccacgatttcaacctgacctctcccgttcatattcaccagtaaaatgccaagtttgattgtacttgtggacagtgacaaaaaaacaggtgcactttatgagaaggcaagtatgcctgaaaatggacctcccagcaagtgggggggctttgggtggaaggaccataagtggtct

SEQ ID NO: 88689 - protein, 145 aa, Zea mays
  misc_feature: Ceres CLONE 1576092
  misc_feature: SWISSPROT Homolog: EC 3.4.23.12 Nepenthesin
MEGRGRPRPGSLQALVVAAAILLLAAVSGVGAGSPDRPAPGPPLFLPLTRSYPNASRLAASLRRGLGDGVHPNARMRLHDDLLTNGYYTTRLYIGTPPQEFALIVDSGSTVTYVPCSSCEQCGNHQDPRFQPDLSRSYSPVKCQV

SEQ ID NO: 88690 - DNA, 818 bp, Zea mays
  misc_feature: Ceres CLONE 1576095
  misc_feature: Encodes the peptide sequence at SEQ ID NO. 88691
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
ctggagctccccgcggtggcggccgctctagaactagtggatcccccgggctgcaggaattcgtctcacccctagaaaaaaagaagagtacgcccactcctccggctcttcttctccaccggcaccagtcttcggcaccggcagcgacgggcacacgctgccgtcggaggtcacccgcgcggcgatgctggtgcgcatcaacaccctcctccagggctactccggcatccgcttcgagatcctcgaggccatcacgaagctgctcaacaccggtgtcagcccctgcctgccgctccggggcaccatcaccgcgtcgggcgacctggtcccgctctcctacatcgccggcctcatcacgggccgccccaacgcgcaggccgtcaccgtcgacggaaggaaggtggacgccgccgaggcgttcaagatcgccggcatcgagggcggcttcttcaagctcaaccccaaggagggcctcgccatcgtcaacggcacgtctgtgggctccgcgctcgcggccaccgtgatgtacgacgccaacgtcctggccgtcctgtcggaggtcctgtccgccgtcttctgtgaggtcatgaacggcaagcccgagtacacggaccacctgacccacaagctgaagcaccacccggggtccatcgaggccgcggctatcatggagcacatcctggagggcagctccttcatgaagcaggctaagaaggtgaacgagctggacccgctgctgaagcccaagcagaactcatcattgccaagtccccactagagacaacgtacgaggggtgctgtgannnnnnnnnnnnnng

SEQ ID NO: 88691 - protein, 197 aa, Zea mays
  misc_feature: Ceres CLONE 1576095
  misc_feature (1)..(198): Pfam Name: PAL Pfam Description: Phenylalanine and histidine ammonia-lyase
  misc_feature: SWISSPROT Homolog: EC 4.3.1.5 Phenylalanine ammonia-lyase
MLVRINTLLQGYSGIRFEILEAITKLLNTGVSPCLPLRGTITASGDLVPLSYIAGLITGRPNAQAVTVDGRKVDAAEAFKIAGIEGGFFKLNPKEGLAIVNGTSVGSALAATVMYDANVLAVLSEVLSAVFCEVMNGKPEYTDHLTHKLKHHPGSIEAAAIMEHILEGSSFMKQAKKVNELDPLLKPKQNSSLPSPH

SEQ ID NO: 88692 - DNA, 816 bp, Zea mays
  misc_feature: Ceres CLONE 1576096
aagctggagctccccgcggtggcggccgctctagaactagtggatcccccgggctgcaggaattcgtctcacccctagaaaaaatccgggagtcaactggtgctatgtccggacgtctcacagacagggtgctacgcctcccgattcactcaagtaccctgctatctggctcctccctaatctaacaattcatcaactctgtacggtttcgtctccgtcggtgcgacaacgtataccacacgagagcctacctcctccctcattcaccggaagacaatgccgattaatggagggtcgcggcctgcctctgccgggctcgctgcaggttctcgtcggctactgcaccatacttctactgataaccaattcctgaggctgcgctagatcccccgatcggcccacgccggggccaccggtattcctcccgctcactcgctcataccccaacggcttccggatcgccgcctcgctgcgagacgcactgaccaacaggggccaccccaacgcacgcatgagcctccacgacgatgctcctcatcaacgggtactacactaccaggctgtacatcgggacgccccagtaggagctcgcgctgatcgttgactcctggagcaacgtcacctacgtgtcccgctccacctggcaatagtgtggttaaccacctagaatccatgattttaaaccatgaccctctagcaacttcatatttctccaactaaaaatgccaacgattgcatttgtaactgtgggtgacagcggaacaaaaaaaaaaggtgtcgaacttttattaaaggaaggaccaaataacgcatttt

SEQ ID NO: 88693 - DNA, 1120 bp, Zea mays
  misc_feature: Ceres CLONE 1576097
  misc_feature: Translation starting site: 248
  misc_feature (1)..(1): n is a, c, t, g, unknown, or other
  misc_feature (16)..(16): n is a, c, t, g, unknown, or other
  misc_feature (23)..(23): n is a, c, t, g, unknown, or other
  misc_feature (24)..(24): n is a, c, t, g, unknown, or other
  misc_feature (31)..(31): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (101)..(101): n is a, c, t, g, unknown, or other
  misc_feature (120)..(120): n is a, c, t, g, unknown, or other
  misc_feature (121)..(121): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (140)..(140): n is a, c, t, g, unknown, or other
  misc_feature (150)..(150): n is a, c, t, g, unknown, or other
  misc_feature (168)..(168): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (177)..(177): n is a, c, t, g, unknown, or other
  misc_feature (179)..(179): n is a, c, t, g, unknown, or other
  misc_feature (181)..(181): n is a, c, t, g, unknown, or other
  misc_feature (182)..(182): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (192)..(192): n is a, c, t, g, unknown, or other
  misc_feature (903)..(903): n is a, c, t, g, unknown, or other
  misc_feature (905)..(905): n is a, c, t, g, unknown, or other
  misc_feature (906)..(906): n is a, c, t, g, unknown, or other
  misc_feature (923)..(923): n is a, c, t, g, unknown, or other
naaaaaggggagaggngaaggannaaagaanaaaanggnnnaagannnnggnntnggnnngttttgggggggtnnnaacaaagctgggactcattgcgggnggggtgccgcattccagcnnagaaatttnnngggnnngnattcctacgncagccgtttagaaaaaanannncgggnanannaannnttggnttttttgccccacaccgggcggcggatacctgtgccagcgacgccggtagaagccatggacagctctctcgcgagcgcggcggcgatagccgatcagcgccagaagatcgagcagtaccgccacatcctcgcctccgtcctctcgacttccccaccggacatctctcaggccaagcgcttcctcgaccacatggtttcggacgaagttccgctcgtggtgtcgcgacaatggctccagattttttttttcgaccccccccacccgggagtcggacgctcagaaaggaggttggccaccacccacacacaaaaaaaccaaccgcggggggggcggcgttcgaaggagcagggggtaagggaaatagaagagaaggcttgccgaagacatatggaggtccgaaaaaaaaaggggggcaaaaggcagcacagaagggctataggggggggaaaggaaccggggaagtccggggaaataaaggggaaggctggaaggggaaacccaaaccagaaaggagttccgagggggggtgaccaaaaagtgggcggagaccaccctagtgtttgggagggagtagagtgaaggggagggggaaaagaacggggagggggtatatatagaaaagagaggaggggtaagatattagggggggcgcaaaagaagagcttacgggggggagggggccagaaaaaggaaggcgtataggggaggangnngggcggggggaggggangatgggggaggggtggaggagaggataccgcgagaaaaccgggcctgagtgggaaggggaggggagatgccagaagagagaaaggacagccccgagagggtgggagaagagagagggagggcgggaaagaggggagggtgtagagaggaggccgggggcgcgtggtggggagaacggacgtgtgacggagggtgagg

SEQ ID NO: 88694 - DNA, 975 bp, Zea mays
  misc_feature: Ceres CLONE 1576098
  misc_feature: Encodes the peptide sequence at SEQ ID NO. 88695
  misc_feature (776)..(776): n is a, c, t, g, unknown, or other
  misc_feature (950)..(950): n is a, c, t, g, unknown, or other
ctggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtactgtccgcgctgcgtgttcgagcccaacgcagctgcgcaaccatgaaggaggggncgcgccgaggcgtcacgggccatgtcgcggcgctggacgaagctgtcgacaagtgccgcgtccggccaaagacgtgggcgtgctggtgggtcaactgcagctcttcacccgacgccctccctggtcggcatgatcgtcaaccactaaagatgcgcggcaacatcctgagctacnacttgggggccatgggcttgcaccc

SEQ ID NO: 88695 - protein, 190 aa, Zea mays
  misc_feature: Ceres CLONE 1576098
  misc_feature (115)..(190): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYCPRCVFEPNAAAQP

SEQ ID NO: 88696 - DNA, 891 bp, Zea mays
  misc_feature: Ceres CLONE 1576101
  misc_feature: Encodes the peptide sequence at SEQ ID NO. 88697
  misc_feature (578)..(578): n is a, c, t, g, unknown, or other
  misc_feature (727)..(727): n is a, c, t, g, unknown, or other
  misc_feature (786)..(786): n is a, c, t, g, unknown, or other
  misc_feature (859)..(859): n is a, c, t, g, unknown, or other
ctccccgcggtggcggccgctctagaactagtggatcccccgggctgcaggaattcgtctcacccctagaaaaagtcccccaagcatcaagctaggcaggcctggtcccgaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggccgggcagctcttcttcggctggctgggcgacaagctggggcgcaagagcgtgtacgggatgacgctcatggtcatggtcatctgctccgtcgcgtcgggtctctcgttcggccacacccccacgggggtcatggccacgctctgcttcttccgcttctggctcggcttcngcatcggcggcgactacccgctgtcggccaccatcatgtccgagtacgcaacaagtagacccgcggcgcctttcatcgcgccgtctttcgcatgcaaggcttcggcatcctcgccggcgcatcgtcacgctcgtcatctccgccgcttncggcgctgcgtacccgtccccggcgtacaagacgaccactcacctccacgtgcgcaggncgactcgtgtggcgggcatcgtaatgctcggggccgcgccgggctgctacctatattgggggatgaaatgccnaaacgcccggtatccgggctggtggcaaaaac

SEQ ID NO: 88697 - protein, 245 aa, Zea mays
  misc_feature: Ceres CLONE 1576101
  misc_feature (142)..(142): Xaa is any aa, unknown, or other
  misc_feature (191)..(191): Xaa is any aa, unknown, or other
  misc_feature (211)..(211): Xaa is any aa, unknown, or other
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFXIGGDYPLSATIMSEYATSRPAAPFIAPSFACKASASSPAHRHARHLRRXRRCVPVPGVQDDHSPPRAQXDSCGGHRNARGRAGLLPILGDEMPKRPVSGLVAK

SEQ ID NO: 88698 - DNA, 866 bp, Zea mays
  misc_feature: Ceres CLONE 1576102
  misc_feature: Encodes the peptide sequence at SEQ ID NO. 88699
gagctccccgcggtggcggccgctctagaactagtggatcccccgggctgcaggaattcgtctcacccctagaaaaagcgccttcctcccgcctccccttccaccaccaagagtgacgacagagagacagacagagagaatggcggcgccagatgcccggccctcgtcagccggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctcctcaacgacaccttctggcgccggcccggcgccggcgccggcgacgacggccccggcccgctgttcgtgtacacgggcaacgagggcgacatcgagtggttcgccaccaacaccgggttcatgttcgacatcgcgcccacgttcggcgccctcctcgtcttcatcgagcaccggttctacggggagtcgaagccgtttcgggacgactcgtacaggtcggccgagacgctgggctacctcacgtccacgcaggcgctgggccacttcgtcgtcgtcatcaggggcctgaagcggggacctcgggcgccgaggccggctcccgttcgtcgtctttcgggggggctcctacggcgggaaaggctgggctttcctgggtttcagggcttcaggtaat

SEQ ID NO: 88699 - protein, 241 aa, Zea mays
  misc_feature: Ceres CLONE 1576102
MAAPDARPSSAGPPPARSLLLPLLLVLLLAAYSLPADSAARPSSNSNPRPAFTPPLLKRHQLRRPSSSSAELVAGPANASTKPFTAHYFPQLLDHFAFTPNASTVFRHKYLLNDTFWRRPGAGAGDDGPGPLFVYTGNEGDIEWFATNTGFMFDIAPTFGALLVFIEHRFYGESKPFRDDSYRSAETLGYLTSTQALGHFVVVIRGLKRGPRAPRPAPVRRLSGGLLRRERLGFPGFQGFR

SEQ ID NO: 88700 - DNA, 936 bp, Zea mays
  misc_feature: Ceres CLONE 1576104
  misc_feature: Encodes the peptide sequence at SEQ ID NO. 88701
tggcggccgctctagaactagtggatcccccgggctgcaggaattcgtctcacccctagaaaaaccctggaaaaactcgccacccaaaagacaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagacttgtccatccttccttcctcttgttagtggtcgtagggtagtttgcactttgcagatagctagctagctagtagttaggggatcaggcatgggtgagggcgaggcggaggtgaagggcggggtgctgcggggccgctacgagctcggccgcgtgcggggtcacggcaacgtcggggcgcgtccacgcggcggggggaccggcgcaccggggggggggccgcggggatggagggtgctcggaaaaggaccaggatgctgcgcgccgggctgggaggggggccggagtaagggggtgagaatcgcgggtgaggaagagggaggggggcgaagcccgggggaggcggggggagactccggcgaagggaaagggggcggcgggggtgcggagaagtgtaagcggggcggctagggaggcgcgggccgggggtggggagggaaggtccttggagagcgggatgttgggcggcctcggcgggcgggagcaagggggaggagaagtgagggggggggggcgggagttgtggcggggggggggagggggggcgctgcgtgggaaggttggaggggccgtgagcgcggggggtaatgagagcgacggccgcgcacgcctgagcggagggagggagggcgcggtcgtcatgggagg

SEQ ID NO: 88701 - protein, 106 aa, Zea mays
  misc_feature: Ceres CLONE 1576104
MGEGEAEVKGGVLRGRYELGRVRGHGNVGARPRGGGTGAPGGGPRGWRVLGKGPGCCAPGWEGGRSKGVRIAGEEEGGGRSPGEAGGDSGEGKGGGGGAEKCKRGG

SEQ ID NO: 88702 - DNA, 1163 bp, Zea mays
  misc_feature: Ceres CLONE 1576105
  misc_feature: Encodes the peptide sequence at SEQ ID NO. 88703
  misc_feature (733)..(733): n is a, c, t, g, unknown, or other
  misc_feature (773)..(773): n is a, c, t, g, unknown, or other
  misc_feature (1163)..(1163): n is a, c, t, g, unknown, or other
ctccccgcggtggcggccgctctagaactagtggatcccccgggctgcaggaattcgtctcacccctagaaaaagtcccccaagcatcaagctaggcaggcctggtcccgaaagaacacccttctctggtcgtcgcagggcagctaacatccgccatggcgcgcgggggagacggcctgcaggtgctgatggcgctggacgcggcgaagactcagtggtaccacttcacggccatcatcgtcgccggcatgggcttcttcacggacgcctacgacctcttctgcatctccctcgtcacctagctgctgggccgcatctactacacggacaccagcaaggacagcccccggtcgctgccgcccaacgtcgcgggcggcagttaaaggcgtggccccctgcggcacccttgtgcgggcagctccttcttcggctggcttgggcaacaagctgggggcgccaataacctgttacggggatgacccctcctggggcatgggtcattctggctccctcgcggtcgggggccctttcggtgcgggcctccccccccccccggggggggcattggggcccaccccttttgtcttctttcccaccttttcgggggcttgggcttattgggaatttccggggggggcgatataacccctgtttttttgcggtgccaccctattctcttgtggcctagaataatccgcccaccaacacatatatgggagataccgggcggggngctcgtctcttatttagtggcggggtcgcgggttttcttngccaaaattgtgaaggtgggctttttgcggtgatttctcctccccccctggggggtattatgttctaaccacgctcttgttcatatttcctcgcgccccgtccgttttgctgtgggggagggagttcccgttctcccgcgcggggtgtgagggggggaaacaaaccctattttctcttcctcacacgtggtccgctggtggcggacacactccgtgtggagggggtgctacataccaacttgttgtgggcgccgcccccccggttgtgtttcttcccttacttttgtggggagatataatatccctccatatagcgcgcgtcccctcgttgacttgtgggtggaaaaaaatataaatcggcgcccgccgaacattccatgggggacgatn

SEQ ID NO: 88703 - protein, 48 aa, Zea mays
  misc_feature: Ceres CLONE 1576105
MARGGDGLQVLMALDAAKTQWYHFTAIIVAGMGFFTDAYDLFCISLVT

SEQ ID NO: 88704 - DNA, 857 bp, Zea mays
  misc_feature: Ceres CLONE 1576106
  misc_feature: Encodes the peptide sequence at SEQ ID NO. 88705
  misc_feature (831)..(831): n is a, c, t, g, unknown, or other
ctggagctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcaccaacctccgcgtgctctcgctccgctccaaccgcgtcctcgggaccgtccccgacgacgtgctccagcttgccagcctcaaggcgctgtttctgcaacagaacctgctctccggccccatcccgacgggaatccagaagctcggcggcctcgagcgcctcgtgctctcccacaacaacctctcgggctccatccccttcgcgctcaacaagctcaccgcgctgcgagtgctcaagctcgacggcaaccacctctccgggagcattnccagcatcagcatcgcggggctcggc

SEQ ID NO: 88705 - protein, 192 aa, Zea mays
  misc_feature: Ceres CLONE 1576106
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (184)..(184): Xaa is any aa, unknown, or other
MAGPSVPAAALAALLAVAALTCCAVAEPPPSERSALLAFLTATPHERRLGWNASTPACGWVGVTCDNANSTVVEVRLPGVGLVGAIPPGTLGRLTNLRVLSLRSNRVLGTVPDDVLQLASLKALFLQQNLLSGPIPTGIQKLGGLERLVLSHNNLSGSIPFALNKLTALRVLKLDGNHLSGSIXSISIAGLG

SEQ ID NO: 88706 - DNA, 821 bp, Zea mays
  misc_feature: Ceres CLONE 1576107
  misc_feature: Encodes the peptide sequence at SEQ ID NO. 88707
ggagctccccgcggtggcggccgctctagaactagtggatcccccgggctgcaggaattcgtctcacccctagaaaaaagcaccacctccgtcaccagagccggcgccgtccgacttccagccgtctcaggcacgcgaactccgacccgatcccttgcttcactaagcaatatcgtctactataactgaaagagaaagaacgccggagcgggagcctgacactgacgccatctctcatccttctcctactccctggttcatatctctcttctgccccctctgcattccatcccgacctcgtctgcgactggtgacaccctctccatcgattcctgccaccgaccacacgctgtcgatcggcattcgccaccggccaaatggaggacatgcggaagcacgcctcaaagttccaggagcaggtggctcggcagcagcaggcggtgatgaagcagttcgagggcgggtatagcgcataccgcatgttcgcgaaccaggccgaggcgcaacagcactacaaggtcgagaagctttacatctccaagaacagcgcctagcacttccaaagggacatagttctcggcgtggagggctacgtgctcacggaggcctagcagtcgtaatcgtgacacagtcatgtgaggatggcaagatgtaccgcaccgagaacacttggagcactggatgcactctgtccaatgcggcggtggagatctgctaatgcacgatccatggtgggaaaagaaatggggtgaacctgctgaaaagccctgggagccaacgtattaaggcatcgtggcctttactgcccgggatgtacgaaa

SEQ ID NO: 88707 - protein, 58 aa, Zea mays
  misc_feature: Ceres CLONE 1576107
MEDMRKHASKFQEQVARQQQAVMKQFEGGYSAYRMFANQAEAQQHYKVEKLYISKNSA

SEQ ID NO: 88708 - DNA, 869 bp, Zea mays
  misc_feature: Ceres CLONE 1576108
  misc_feature: Translation starting site: 94
  misc_feature: Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
  misc_feature (869)..(869): n is a, c, t, g, unknown, or other
aagctggagctccccgcggtggcggccgctctagaactagtggatcccccgggctgcaggaattcgtctcacccctagaaaaaaactgatcggatggcggccttgaccttccacccggccgcctgcttcttcccacgaccacgagaggcagcagcgacaacgaagcagccgctccaccattactgctcgcctctccggaccctcgtccctagaactacaagaccgtgccttctcagggccaggtcctccaacgggctcccgcagaccggcggcgcctcgttcggcagcagcaacgaggtgctggatgggacgccgacgggagatggggcaccggggcaggggcagcggggagggagcaccgtcagcatcacggtcgtcggcgcctccggcgacctcgtctacacccccaccttcccggctctcttcgccttgttctacgagggctggctcccggagcattttacagtgttcggctatgcccgtggcgagatgaacgaccatgagctcaagaacatgattagcatgaccctgacgtggccgaagcgacaaaaaggagaactgcggcgcacagatggatcagttcctgaagaggggcttctaccagtctgggcaatacaactcggaagaaggggtttgccggaatttggaccgaaaggctcaaaaaaaaagaggcagggctggtttcccgaaacagggctatttttaccttgtccgatccccgccccaaacattattaccctgggaaggttgggaggaagatcccggctatacaccggcaaccgggcgttcggtccttttcaaggccggggggtgggacacgaggaattttatataagggtgggaaagaaaggctccatttttctggggtn

SEQ ID NO: 88709 - DNA, 968 bp, Zea mays
  misc_feature: Ceres CLONE 1576111
  misc_feature: Encodes the peptide sequence at SEQ ID NO. 88710
  misc_feature (393)..(393): n is a, c, t, g, unknown, or other
  misc_feature (399)..(399): n is a, c, t, g, unknown, or other
  misc_feature (624)..(624): n is a, c, t, g, unknown, or other
ctggagctccccgcggtggcggccgctctagaactagtggatcccccgggctgcaggaattcgtctcacccctagaaaaaaaaacaaaaaaaaaaaaaaaaatttagcttttgcctccgtttcgctttgataaataaaagccataactcccggccgtccatcgctcgcctcccctccctccctccccgccgctgtctccggcgacagccagcctcatcgtccatggcctctacatgcctagcccccgcctccctctccacgcccctgctctccgactccatcgcgcgcgcgcccgccgccaacgggcacgccaccaaccaccgacaccaccaccacgacgacagcgacggtgctgcggcggtctccgtttgcgacgacggcggcggggacccncccccnttcctctcggaggaccggccgccgagggaccgagggccgtccccggccgacccgttccgcaacggcacaccggcgtggggcggcggcttgtacgcgtggtcgaggacgctgctgctcctgccggtcgcgttggtgcggctggcactgttcgggctctccatcgcgatcggctacgcggccacgtgggtggctctccgcgggtgggcggacacgcacgggaagccncgggtgggcggcgggcctatgccggcgtggcgcccccggctcatgtggatcacgcggatctcagctcgctgcatcctcttctctttcggggtacatttggaacaaaaagaaagaaaggcccgcccgtagggagctcgcacctattgttgtttccaatcaaatcccggaacaagaaaaccatattcttcctccaagaaatgggtcccaaccacttggtttcatcagagatcccaggaagcccctaccattttggtggaaaaaattatttcaagggaggcaaggtataaatagttgagaaaatcctcccacaccttcccgggaagagtgccgggaaaggaaaaaaa

SEQ ID NO: 88710 - protein, 176 aa, Zea mays
  misc_feature: Ceres CLONE 1576111
MASTCLAPASLSTPLLSDSIARAPAANGHATNHRHHHHDDSDGAAAVSVCDDGGGDPPPFLSEDRPPRDRGPSPADPFRNGTPAWGGGLYAWSRTLLLLPVALVRLALFGLSIAIGYAATWVALRGWADTHGKPRVGGGPMPAWRPRLMWITRISARCILFSFGVHLEQKERKARP

SEQ ID NO: 88711 - DNA, 775 bp, Zea mays
  misc_feature: Ceres CLONE 1576113
  misc_feature: Encodes the peptide sequence at SEQ ID NO. 88712
acccgcggtggcggccgctctagaactagtggatcccccgggctgcaggaattcgtctcacccctagaaaaagaaccaaaccaaaccaaaccaaaccaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgtcggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatgaagtgcaagtatgtagaactcacttcagactttgtgtatccctacagaaatcagggtggatttgatatgatctgcagtggaagggacaagattgaaacaccggagcagtttaagcaagctgaagacacggccaacaagcttgatttggatggacttgttgtcattgggtggtgatgattcaaacaccaatgcctgcctccttggtgaatacttc

SEQ ID NO: 88712 - protein, 195 aa, Zea mays
  misc_feature: Ceres CLONE 1576113
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVVGPASSAAGNPDEIAKLFPNLFGQPSASLVPSAEPAATRPLKIGVVLSGGQAPGGHNVICGIFDYLQERAKGSTLYGFKGGPAGIMKCKYVELTSDFVYPYRNQGGFDMICSGRDKIETPEQFKQAEDTANKLDLDGLVVIGW

SEQ ID NO: 88713 - DNA, 897 bp, Zea mays
  misc_feature: Ceres CLONE 1576114
  misc_feature: Translation starting site: 192
  misc_feature: SWISSPROT Homolog: EC 1.4.1.2 Glutamate dehydrogenase
  misc_feature (820)..(820): n is a, c, t, g, unknown, or other
  misc_feature (897)..(897): n is a, c, t, g, unknown, or other
ggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaccgctgctgctattgcctatggtcttgacaagaaagcaaccagcgtcggtgagaagatgtcctcatctttgaccttggaggtggtaccntcgatgtctccctccttactattgaagaaggtatccttgaggtcaggccacagctggcgaccccatctttggggtgn

SEQ ID NO: 88714 - DNA, 1038 bp, Zea mays
  misc_feature: Ceres CLONE 1576115
  misc_feature: Encodes the peptide sequence at SEQ ID NO. 88715
  misc_feature (58)..(58): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (92)..(92): n is a, c, t, g, unknown, or other
  misc_feature (481)..(481): n is a, c, t, g, unknown, or other
tacaacataattaacaaaaaaaaaaagaagaaaagagagagcaaacaccaaaaccaanccnncccccnncccncccaaactggaactcaccncggtggcggccgctctagaactagtggatcccccgggctgcaggaattcgtctcacccctagaaaaaactttagctcctcccactgctataggcagcccacatgcgcgcgcactcccaagtcccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgacgtcggcttcatcgtgctcgtcatcttcctggcgctgcgcccctccaagccgtccttctacctgcaggacgtgcagctgcgctccatcgacctcacccacccngcgctctccctcgacctccaggtgacgatcgcgtcgcggaacccgaacgagcgggtgggcgtgtactacaagacgctggacgcgttcaccacgtacccgcgactaggcgggtgaacggtcccccgtgtccgatggccggcggatactaccaagggccaccaaggcaccgtgatccggttgttgggtcgccccggctcaatgttcgggggcggaccgcagggttcccccgtgggaccgcaagcttaacgtgtgggccgggaacgccccattggaaaagccatggaaacattcttaaggggcgggggaataaccggtggcctggcctcccaccgttcaagggattgggaacggggccccccgttctaaggtgggaaagggtcctggcaggcctgggtggtccttccgggccaagcattacccacccttcctttccgttcaaactgggcccccggggccttgacttcaaccaaccaggcggggaggcgtacttgaccgttccacccacccggggcgggctggagattattttctgccgcactaggggcctgtggttcggt

SEQ ID NO: 88715 - protein, 100 aa, Zea mays
  misc_feature: Ceres CLONE 1576115
MSKEKHHRDWILRRCCGSLAACILTLAADVGFIVLVIFLALRPSKPSFYLQDVQLRSIDLTHPALSLDLQVTIASRNPNERVGVYYKTLDAFTTYPRLGG

SEQ ID NO: 88716 - DNA, 796 bp, Zea mays
  misc_feature: Ceres CLONE 1576116
  misc_feature: Encodes the peptide sequence at SEQ ID NO. 88717
  misc_feature (668)..(668): n is a, c, t, g, unknown, or other
ctccccgcggtggcggccgctctagaactagtggatcccccgggctgcaggaattcgtctcacccctagaaaaaatcgccagggcgtcggatcggagcgagctcattctcaactcgactcaagagctctgcctcctccatcttcccttctctttctggacgttgagggcctccggggccacgctgagagatggaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccgggtggggatctacggagcgaactgtcctcagtggatagtggcaatgcaggcttgcaatggctatagtctagtctgtgtcccactgtacgatactttaggtgcgggagctgtcgactacatcatcgatcatgccgagatcgatgttgtcttcatacnggacaagaaaataaaagagatactgtccccaaactgcaagtctgccaagagactgaaagcattgggtggcgttcacttcggcgacaactgaacagaacaaagaagcggatcaaatttgggatccaaaa

SEQ ID NO: 88717 - protein, 189 aa, Zea mays
  misc_feature: Ceres CLONE 1576116
  misc_feature: SWISSPROT Homolog: EC 6.2.1.3 Long-chain-fatty-acid--CoA ligase
  misc_feature (160)..(160): Xaa is any aa, unknown, or other
MEANPKNTFTIKVEDGKPGKDGRLAVGPVFRSVLAKDGFPQLEPDMKTSWDVFRVAAVKYADNRMLGWRPFKDGVPGPYLWKSYKEIYDEVLQAGSALQKLGVQPGSRVGIYGANCPQWIVAMQACNGYSLVCVPLYDTLGAGAVDYIIDHAEIDVVFIXDKKIKEILSPNCKSAKRLKALGGVHFGDN

SEQ ID NO: 88718 - DNA, 1087 bp, Zea mays
  misc_feature: Ceres CLONE 1576117
  misc_feature (21)..(21): n is a, c, t, g, unknown, or other
  misc_feature (36)..(36): n is a, c, t, g, unknown, or other
  misc_feature (56)..(56): n is a, c, t, g, unknown, or other
  misc_feature (69)..(69): n is a, c, t, g, unknown, or other
gtttgtgtttgttttttttanagtgtgtttttattnatatttttttataatttttnttattatgtgatnactctgagtcaaactggaactccccgcggtggcggccgctctagaatagtggatcccccgggctgcaggaattcgtctcacccctagaaaaagcaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaaacaggaggccgccccctgtgacgaatcaaggacgtgggacctcaggctctcaatcaggcccgcggcccgaacaaccgggggagcctcccccggccccgggtgggccgggaaaggtcccaacgggcaggcaaaacaaaactgggggaaggggggtccttgccttgggaacccccccatttccgaaccgggcgggttggccttccccctcccccggggggagaagcgttccaatccccccggcccccatacaacgtgggctaaaaaatgttatccgccgccccccccaggggcccccaacaccctcttaacctaaaacaaagaccttttttccgtaaccttttacggaaaaccggccgtttttcctttactccccccctcaataaaggtacggaaataaagaccctggcaaaaaaaataaaccccccggcgacaaaaaaaaaacatttttcttttcaccaaccaataagtgctgtgtagccacctgggagggggcaatacagggggtaaaaaaaaagggtgtaaaccccgggtaaagcctgtgaatacggccgcacattgtgaaaaaaaacccttctagggtttcccccacattttttgg

SEQ ID NO: 88719 - DNA, 818 bp, Zea mays
  misc_feature: Ceres CLONE 1576120
  misc_feature: Encodes the peptide sequence at SEQ ID NO. 88720
gcggtggcggccgctctagaactagtggatcccccgggctgcaggaattcgtctcacccctagaaaaatggacgtagtagtacgtggacgatgccaatcccagtgtttgtgtttgtcgcctagacgcctcaaggccctctttccccctctccgccttgactcactcacttggccactcttcttcctcctcatcaatccgctctccagcacttgttcggaagaaaaagaagctagaacacgctaacaagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactatggggtcgtcggcatcggcacaccgccgcagaacttcaccgtcatcttcgacaccggcagctccaacctctgggtcccctccctcagatgctacttctcgattggctgctacctgcaccacagatacaagtcgggcaagtctaacacgtacaaagcggaacggcgagaactgcaagatcacctacgggctccggcttcaatcgccgggtttcttcaaccgacgacaaacgtgctgggtcgggggacctgaccggtcaaaaacccaaaagttcatccaagaacaagccga

SEQ ID NO: 88720 - protein, 172 aa, Zea mays
  misc_feature: Ceres CLONE 1576120
  misc_feature: SWISSPROT Homolog: EC 3.4.23.40 Phytepsin
MGRGRGHLLLPAAAACLWALSCALLLRASPHRAGAGAGGLLRVGLSRRGGGLDQRALAAAKAARQQEASRLGASGGGDVPLVDYLNTQYYGVVGIGTPPQNFTVIFDTGSSNLWVPSLRCYFSIGCYLHHRYKSGKSNTYKAERRELQDHLRAPASIAGFLQPTTNVLGRGT

SEQ ID NO: 88721 - DNA, 831 bp, Zea mays
  misc_feature: Ceres CLONE 1576122
  misc_feature: Encodes the peptide sequence at SEQ ID NO. 88722
tggagctccccgcggtggcggccgctctagaactagtggatcccccgggctgcaggaattcgtctcacccctagaaaaagacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgacccgacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaggttcatttcatccttaagcacaagaatcctaagactggaaagtatgttgagcatcacctcaaattcccaccttctgtcccatacgacaagctctctcatgtctacacagctatcttgaagccagacaatgaggtcagaattttgatcgatggggaagaaaagaagaaggcgaacttcctttctgctgatgactttgagccagcacttatcccatccaagaccattcctgaccctgatgacaagaagcctgaagactgggatgat

SEQ ID NO: 88722 - protein, 231 aa, Zea mays
  misc_feature: Ceres CLONE 1576122
  misc_feature (24)..(231): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDPTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDNEVRILIDGEEKKKANFLSADDFEPALIPSKTIPDPDDKKPEDWDD

SEQ ID NO: 88723 - DNA, 955 bp, Zea mays
  misc_feature: Ceres CLONE 1576125
  misc_feature: Encodes the peptide sequence at SEQ ID NO. 88724
ggagctccccgcggtggcggccgctctagaactagtggatcccccgggctgcaggaattcgtctcacccctagaaaaacccctagaaaaaacacgcacggacggccccgagggtttagagcccaacttctctcttcacatcgccgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatacccaagccaagaacttggcagctattagagcattcggcagtgaagggaaagtgaagggtcaaagtactgttctgccaattgaagttgttcaaccttctggagctcccccggagctgacattctttttcagcattgttgccccaacctttggaaaaaaggaaagactctgtacttgggatgttcttgactgtgtttcacacacctcttcttcaccctttcccagaagaaatcacctcaagcccgaagccccaaccttgtttgttcaatccggggaaaggggctccaccattctggtccccctttccccgggttaaagggctcaaaacccctttgctaattaaaaatagcccctggggggaaaggggttgaaatctattccccaagggggtttccaaaaccccaaaaaatctgtgggggattctccaaacctggagaaatgtgggagccctctttcttgtgggacccttcccccccgttttctctccaaataatacaggggggagaggtggcgcactttttggggaagaaacacaaatcccttttttgtggggggtgg

SEQ ID NO: 88724 - protein, 176 aa, Zea mays
  misc_feature: Ceres CLONE 1576125
MATPPPPIRPAAALLLLVLAGVLASAASADLVISKADRRVDLTSHIVRVLASLKAENVGPDPVSQVLLPFPNTQAKNLAAIRAFGSEGKVKGQSTVLPIEVVQPSGAPPELTFFFSIVAPTFGKKERLCTWDVLDCVSHTSSSPFPRRNHLKPEAPTLFVQSGERGSTILVPLSPG

SEQ ID NO: 88725 - DNA, 817 bp, Zea mays
  misc_feature: Ceres CLONE 1576127
  misc_feature: Encodes the peptide sequence at SEQ ID NO. 88726
  misc_feature (335)..(335): n is a, c, t, g, unknown, or other
  misc_feature (338)..(338): n is a, c, t, g, unknown, or other
  misc_feature (341)..(341): n is a, c, t, g, unknown, or other
tggagctcaccgcggtggcggccgctctagaactagtggatcccccgggctgcaggaattcgtctcacccctagaaaaaaaaggctcacaatacccacctccatttagctactactactccctcgctgtcttccgcaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggcaggggcggcgcccgaagagacngcnccncaagaacccacattgccaggcaacggctccggcgctaccggcgcgccggcggtcggggtcaactccaactccgtgctggtggcgctgctggattcgcactacaccgagctggcggagctggtggagaaggcgctgctcctgcagacactggaggacgccgtctggaagcacaaagtcacatcttcgggccggggacgaagcgctggaacgggactgggaccggagttcaggcgcttcctggtggaagcggaaaaactcaggggcgtacaggccctgctggtttaacaggtcggccccttggggccggccctacgaattctgggccgaagagggcccaccccacgcttgtccggggaggaaggccgaaattcggagccgggcaaagggaatttcgcccagcccgggcataaaaacagccctgggacagccaggtttcagggcccaccagggggcccacccgcgggggatcctatgcg

SEQ ID NO: 88726 - protein, 122 aa, Zea mays
  misc_feature: Ceres CLONE 1576127
MGAPVHGALALFLLLLVGAGAAPEETAPQEPTLPGNGSGATGAPAVGVNSNSVLVALLDSHYTELAELVEKALLLQTLEDAVWKHKVTSSGRGRSAGTGLGPEFRRFLVEAEKLRGVQALLV

SEQ ID NO: 88727 - DNA, 942 bp, Zea mays
  misc_feature: Ceres CLONE 1576131
  misc_feature: Encodes the peptide sequence at SEQ ID NO. 88728
  misc_feature (750)..(750): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaagaccttcttccacgacgtcggcctcggcggcatcggctacgaggtcacccgctacctctacgccacctgcaacgacctcaagttccccactcngatcaacgcgcacgcaatgtgacagcgactctcgtatgctgccaagagcgtccgatcgtggccccaggatgaacgagccgcagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 88728 - protein, 172 aa, Zea mays
  misc_feature: Ceres CLONE 1576131
  misc_feature (166)..(166): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKTFFHDVGLGGIGYEVTRYLYATCNDLKFPTXINAHAM

SEQ ID NO: 88729 - DNA, 809 bp, Zea mays
  misc_feature: Ceres CLONE 1576132
  misc_feature: Encodes the peptide sequence at SEQ ID NO. 88730
ctggagctccccgcggtggcggccgctctagaactagtggatcccccgggctgcaggaattcgtctcacccctagaaaaattccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtggaaaggtggtgtccactcccgccttgaccaactacagttacttctgaaaggtgtcagtgagagaggagcaaaaaaaattcgtgtgcacatccttaccgatgggcgtgacgttttggatggaagcagtgttgggtttcgtggagaccctagagaatgatcttttggagcttcgagggcaaggtattgatgcacagattgcatctggtggggggaaaggaatgtatgttacaatggaccggttatgagaatgt

SEQ ID NO: 88730 - protein, 147 aa, Zea mays
  misc_feature: Ceres CLONE 1576132
  misc_feature (15)..(148): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSGKVVSTPALTNYSYF

SEQ ID NO: 88731 - DNA, 2486 bp, Zea mays
  misc_feature: Ceres CLONE 1576133
  misc_feature: Encodes the peptide sequence at SEQ ID NO. 88732
actcgaagaggaaaaaggaaaaaaagaaaacagggagagcccaagcctgagacgaacacgaagaagcaaggagcgaagcagacacgagcgagcccatcccaagttcccaacccacacgaagctgcagcagcaggcagccgcctcgccacgcgcccgagcaacgccgccgagagagccgcccgcccgcccgcccgccggtgagcagcgagggcaattcgtcttcggctggtccccgtcccgctcccgcccgccaaccccaattgctcccctctcggaggtcagctcaattcctgctgtttctcggattcgattcggttgcaccgggcgcgtcgtctccctcgccggagatccagcaggtacgagctcgcctggggccgaggatcatgcccccattgctctagggtttgggtgggtaatccaattggctcgccaggcccgcggcctctatgcttgattcgggcctgccgcgccgctccctgggatctcgcggcggttggtgcggcgccagcggtgatgagatcccctccatggccggcgagctgggaattggggtacgggctcgctctctgcaggaagcggcgcaagccctaatggtttgatcctagctgggtgcggcgtgctatccccaattcattggtttctctactccgggtctgatattggggtttgctgcggtggtaactgcatggacacagtaagggaggaggcatggccagtggctgcaccgcggcagcagccatcagctccccaaccgcagcagcaacagcagaatggccgtattgatctcagggagctcaaagctcagatggagaagcagcttggtccggatcgctcgcggcgatattttggctacttgaatggctacttatcagagaggctcggcaggcaagactttgaaaagctgtgcctgcataccctggggcgggagaaccttcaactgcacaaccggctaatccgtgcaattctctacaatgcctaccagggaaagtgcccgccacctccactggatgcagggagacctgtaggagcatcagtaaagaaggcttatcaggctgctgaagtgttgaatgcttgcaatggtgatgccaggttgttacagattcagagattgaggcctgtggccagagcacaggatcatactttaaaagacagtacaaataacacgggtccaaattgtagggtggctgctgccaatcacaaccaagttactcacgatgcttctggatctctggagaatggtacactaaatcaacttgagttgaagagattgcgttttcaacaatgcgaacctgtagagccagtggcaaagcatccgcgtgtggaacagttgccacccaataatttgcctgtacagagaagaagcatgagcagcactgcagaacagtctgcagaaatattgagaagtcctgtacgagctccactgggaattccattttgttcagcaagtgtgggtggtgcaaggaaatttccacctccactaattgttgcaggtgaggatcacttcaacagctgttctgagcatgatgggctgttcagcactgaactgctgcatagacggatggagaaaacagcagaaacgctgggtttagctggtatcacaatggatagtgctgagcttctgaatattgctctggacaagtacatgaaaaacctgattaggtcatctgttgagttagtaggaggtagtgttcagagggatgcaaggaaagggacaccaacctacaagcagcaagcctatggaaagcagattaatggtgtccggctgccaaaccatgttcatatgcaatcagccagtggatcaccaggagccaagaatgagattggaattaaccatttgatctccatcaatgactttaaggtagccatgcagctaaaccctcaacatctcggggagaactggccagtccttctggagaagatatgtctatgttcttcagaggaaaatgactgacatatggcacttttttacttcacagcgaagttttgtaccaatgtgcttactggtgcccatccgatgtacatttgagctggaagtggcaagattgcaggcacaacacaaaatatgcacatgtggggtcaaggcagaaatctgatcaacgttcagctgtcagagttgtactgaaagaaagacattctttttttcctgatacatcatgctcaaataaaggaaaacatcttctgttctggccatgcagcttaggcctcattagcacttacaaggtggatagtgttacatccaaaagtcccaacttctatgtaacatctggcataagggactggggcagcaaaatgcaagtgctgtcttgtaacttataggaaaatgttctgtaagtttctaggtcaggatgtacattattgattgcaaaaattttctaggtatcttcagtactaatttcagggatctcgaatgttcatttaattcttttgtaactctgctatgagaattatatgttagatctctacctttctaaaaaaaaaaaaaaaaa

SEQ ID NO: 88732 - protein, 421 aa, Zea mays
  misc_feature: Ceres CLONE 1576133
MDTVREEAWPVAAPRQQPSAPQPQQQQQNGRIDLRELKAQMEKQLGPDRSRRYFGYLNGYLSERLGRQDFEKLCLHTLGRENLQLHNRLIRAILYNAYQGKCPPPPLDAGRPVGASVKKAYQAAEVLNACNGDARLLQIQRLRPVARAQDHTLKDSTNNTGPNCRVAAANHNQVTHDASGSLENGTLNQLELKRLRFQQCEPVEPVAKHPRVEQLPPNNLPVQRRSMSSTAEQSAEILRSPVRAPLGIPFCSASVGGARKFPPPLIVAGEDHFNSCSEHDGLFSTELLHRRMEKTAETLGLAGITMDSAELLNIALDKYMKNLIRSSVELVGGSVQRDARKGTPTYKQQAYGKQINGVRLPNHVHMQSASGSPGAKNEIGINHLISINDFKVAMQLNPQHLGENWPVLLEKICLCSSEEND

SEQ ID NO: 88733 - DNA, 832 bp, Zea mays
  misc_feature: Ceres CLONE 1576141
  misc_feature: Encodes the peptide sequence at SEQ ID NO. 88734
  misc_feature (89)..(89): n is a, c, t, g, unknown, or other
  misc_feature (395)..(395): n is a, c, t, g, unknown, or other
  misc_feature (529)..(529): n is a, c, t, g, unknown, or other
  misc_feature (536)..(536): n is a, c, t, g, unknown, or other
  misc_feature (561)..(561): n is a, c, t, g, unknown, or other
  misc_feature (571)..(571): n is a, c, t, g, unknown, or other
  misc_feature (577)..(577): n is a, c, t, g, unknown, or other
  misc_feature (682)..(682): n is a, c, t, g, unknown, or other
  misc_feature (694)..(694): n is a, c, t, g, unknown, or other
  misc_feature (790)..(790): n is a, c, t, g, unknown, or other
ctccccgcggtggcggccgctctagaactagtggatcccccgggctgcaggaattcgtctcacccctagaaaaagcgccgccaccgccnccgtctagcattttcctacacccaatctgatctgaccaagccctctgaacaccaccgcccatcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcncggggctcgaggactccatcgggctcgcgtccgcggacgactcgtccttccgcctcgtcgatggcaaaccgccgccgcggcacccgcggtttggacctcgctggcgcttccagcagcggccccaactcccgcancgccccnacaaaaaggtcgaggctcggcgtcncgaggccaanaaggancgcgcccgccgcgaccgccactggcagcaaaaccgccgcacgcaccaccagttcaaccgcggcggggcctcctcgtcgtctgccaaaccgtccgttgacatccancccaaatgttcngtgaaagagcaaatcccttttctatccttctccaagctctcccttccccgtcccccaaccagcccgaggaatctcctccttctgtggcgcaattcnaatactaccaaccggaccttacgatcgcggtcacccccgggg

SEQ ID NO: 88734 - protein, 217 aa, Zea mays
  misc_feature: Ceres CLONE 1576141
  misc_feature (72)..(72): Xaa is any aa, unknown, or other
  misc_feature (116)..(116): Xaa is any aa, unknown, or other
  misc_feature (119)..(119): Xaa is any aa, unknown, or other
  misc_feature (127)..(127): Xaa is any aa, unknown, or other
  misc_feature (130)..(130): Xaa is any aa, unknown, or other
  misc_feature (132)..(132): Xaa is any aa, unknown, or other
  misc_feature (167)..(167): Xaa is any aa, unknown, or other
MGFDVGLVPYNPDGWGPPEVAAAPPSLGGGSSSVPFAPFSRSDKLGRIADWTRNPPGPGAFAAARDAVFDFXGLEDSIGLASADDSSFRLVDGKPPPRHPRFGPRWRFQQRPQLPXRPXKKVEARRXEAXKXRARRDRHWQQNRRTHHQFNRGGASSSSAKPSVDIXPKCSVKEQIPFLSFSKLSLPRPPTSPRNLLLLWRNSNTTNRTLRSRSPPG

SEQ ID NO: 88735 - DNA, 867 bp, Zea mays
  misc_feature: Ceres CLONE 1576143
  misc_feature: Encodes the peptide sequence at SEQ ID NO. 88736
aaagctggagctccccgcggtggcggccgctctagaactagtggatcccccgggctgcaggaattcgtctcacccctagaaaaaaagggcccaaggcttctccttctagggattcatcttcctctcgtcttccctcttcctctccgaggatacaaggcgccgtcccaggtagaggtagggtcgccaccatgctggaggagctgctcatcttcacccggggcggcctcatcctgtggtcgtcctgccgggcgctcggcgccgcagccctcaagggctcccccatcgacgccctcatccgctcctgtctcctcgaggagcgatccgccgacgccagcttctcccaggacaattacgccctcaagtggaccttccacaacgacctcggccttgtcttcgtcgccgtataccacaagatactccacctcctctacgtcgacgatctcctcgccgccgtccgcaaggagttctcccagatctacgaccccaagcgcacctcctacgatgactttggggacatcttccgccagctccaccgcgaggcccaggcgcgcgccgaggaaatgaagaagtccaagcaggccctctcgtcccgtccgcagcctgctctcacccagaagaagcctgggtccaaagggccgcggcgggtgattcccgcggggggggctgctaacaagggcggcttctgtggcaagggatgactctgaatggccacgggctattggcaaccaggacccaccgtactcttggcaaatgggggccttccaagggcccaagagaatagtggtcccccaaaaaggaattctttctcatgggcccttcctgtttgcaaaggggaaaagggagaatgggggcccccccaaggattga

SEQ ID NO: 88736 - protein, 169 aa, Zea mays
  misc_feature: Ceres CLONE 1576143
  misc_feature (27)..(169): Pfam Name: SRP-alpha_N Pfam Description: Signal recognition particle, alpha subunit, N-terminal
MLEELLIFTRGGLILWSSCRALGAAALKGSPIDALIRSCLLEERSADASFSQDNYALKWTFHNDLGLVFVAVYHKILHLLYVDDLLAAVRKEFSQIYDPKRTSYDDFGDIFRQLHREAQARAEEMKKSKQALSSRPQPALTQKKPGSKGPRRVIPAGGAANKGGFCGKG

SEQ ID NO: 88737 - DNA, 848 bp, Zea mays
  misc_feature: Ceres CLONE 1576144
  misc_feature: Encodes the peptide sequence at SEQ ID NO. 88738
ggagctccccgcggtggcggccgctctagaactagtggatcccccgggctgcaggaattcgtctcacccctagaaaaactagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacatgcgcctcgggtaccactacctcatcagccacggcgtgtacctggccaccatccccgtcatcgtgctggtgtgcggcgccgagctgggcagcctcagccgcgacaagctgtggcgcaaggtgtggggggaggccacctacgacctcgccaccgtgatcgccttcgtcgccgtcctcgccttcaccatctccgtctacatcatgtccaggcccaggaacgtgtacctcatcgacttcgcatgctacaagccggccgacgagctcaaggtgtccaaggcggagttcatcgacctgacgcgcaagtccggcaagttcgacgaggacagcctgtcgttccagtcgcgtctgctggacaagtccggcatcggcgactagtcgtacatgccgcgctgcgtgatcgaactcaactgcagctgcgccacatgaaggaagggcgcagccgaggcgtcacggccatgtttcgcggcgctggaggacctgttcgaaagtgccgcgatccggc

SEQ ID NO: 88738 - protein, 173 aa, Zea mays
  misc_feature: Ceres CLONE 1576144
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYMRLGYHYLISHGVYLATIPVIVLVCGAELGSLSRDKLWRKVWGEATYDLATVIAFVAVLAFTISVYIMSRPRNVYLIDFACYKPADELKVSKAEFIDLTRKSGKFDEDSLSFQSRLLDKSGIGD

SEQ ID NO: 88739 - DNA, 943 bp, Zea mays
  misc_feature: Ceres CLONE 1576145
  misc_feature: SWISSPROT Homolog: EC 2.3.1.119 Icosanoyl-CoA synthase
ctggagctccccgcggtggcggccgctctagaactagtggatcccccgggctgcaggaattcgtctcacccctagaaaaagtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgctgccccgccgcgcgccgccgtccccatcgccctccgcctacacgcgcgccaagccgcgcccccctcccgcccccaccgacgactcgctggacaacccggatctggggcccttcctcctgaagcaggcgcgcgacgccatgggtgcggggtaggggcggcaggctccgcccccacgatctatgtcgcaaagcgcggggggaggccacttacgacctccccacagggctcggattcctagctgtcctcgactttaccatctccgtctacattatgtcgaggcccaggcccgtgtacctaatccatttctgatgctaagagccggccgaccagctccaggtgtccaaggcagagttcatccacctggcgcgaaagtccggaaagttcgacgaagacagcctggcgttccactcgcgtctgctggacgagtccggcatcggcgacgagtcgtacatgccgcgctgcgtagtcgaggccaactcagctgcgccaccatgaaggcaggccgcgccgaggcgtccacggccatgttcgcggcgctggacgagctggtccacaagtgacgccgtccgggccaaagacgtgggcgtgctaggtggtcaatggagccccttcgaaccgacacctcccctgtccgcatgattgtcaaccacttcagaagggcggtcacaaccc

SEQ ID NO: 88740 - DNA, 767 bp, Zea mays
  misc_feature: Ceres CLONE 1576150
  misc_feature: Translation starting site: 137
  misc_feature: SWISSPROT Homolog: EC 1.6.5.3 NADH dehydrogenase (ubiquinone)
  misc_feature: SWISSPROT Homolog: EC 1.6.99.3 NADH dehydrogenase
  misc_feature (576)..(576): n is a, c, t, g, unknown, or other
ctccccgcggtggcggccgctctagaactagtggatcccccgggctgcaggaattcgtctcacccctagaaaaaattggggttctgactcggaacctgatcagtgagtgtggtcttctgaaagcgagcaaaggaggatggggttctccttcttcacctcccgagccggtgctcgactgctggacgggatcgcgcgccccggcttctccaccgccgcgcttctgctcacagcggccagtggcggaggccttgtggcgtacgcggattccgctgcagagagcgcgccggagccatctcaggatgctcccaggaagaaggtggtggttcttgggactggctgggctgggacgtcgttcctcaagaacctcgactgctccaggtatgaagtgaaggtcatatcgccccggaactacttcgcgttcactcctctgcttccgagtgtcacgtgtgggactgtcgagccgcgcagcattattgaaccggtacggaggatgtttgagaagaaaaacaaggatgtcacattttgtgaagccgagtgtttcaagattgatgcaaatagaaaaactgtacattgccngttctgctgttggaactaatcttgatgggaatggtgattttatgttggattatgactacttagttgttgctcttggggctactgtaagtacatttaacactcctggagtgctggagcactgctgctttttgaaggaagtagaggatgctcagaagatacggaagggtgtgatagattgttttgaaaagcat

SEQ ID NO: 88741 - DNA, 814 bp, Zea mays
  misc_feature: Ceres CLONE 1576152
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaattccgtaacaagctgagaggcagcatcccggagctcgtcggcgacctgcccagcctcgaggtgctgcagctctgggagaacaacttcaccggcggcatcccgcgccggctcggccgcaatggacggctccagctggtcgacctctcgtccaacaggctcaccggcaccctcccgccggagctgtgcgccgggggcaagctggagacgctcatcgcgctaggcaacttcctctttggctcaatccctgaaccactggggaaatgcgaggcactctcccgcatccgcctcggcgagaactacctgaacggttccatcccggaaggtctctttgagctcccgaatctgacgcaggtcgagctgcaggacaacctcctgtccggcggcttcccggcggtttccggcaccggtgcgccgaatctgggggcgatcactctctccaacaaccagctcaccggcgcactgccggcgtccatcgggaagttctcaggtttgcaaaaactgcttctcgaccagaatgcattcaccggcgcagtaccgccggagattgggcggctgcagcagttgtctaaggctgacctgagcggcaacacgcttgacggcggtgtgccgccagagatcggggaagtgccggttgctcacctacctggacctcagccggaacaacctgtccgggaagataccgccggccatctccggcatgcgattactcaactaccctgacctgtcccgtaaccacctca

SEQ ID NO: 88742 - DNA, 799 bp, Zea mays
  misc_feature: Ceres CLONE 1576153
  misc_feature: Encodes the peptide sequence at SEQ ID NO. 88743
  misc_feature (497)..(497): n is a, c, t, g, unknown, or other
ggagctccccgcggtggcggccgctctagaactagtggatcccccgggctgcaggaattcgtctcacccctagaaaaagaacgaagcatagcaagcaaacccagctcgatcgcctctcgcactccgcgatccatctctggcctgccgcgcgcgctcggcacgccagaaggaaggacgtaccagaggcacacaatttcaaatggcggactgcatgcaggagtggccggagcccgtcgtccgcgtgcaggcgctcgccgagagcgggctgtccgtcatcccgagctgctacgtcaagccgccgtgcgaccgcccggccccggccccggccccgaccatggcaccaccggcgccggcagtccatccgaggaagaaggagcccagctcggacgccatcgccagcattccggtcgtcgacctcggcgagctgctggccgcagacggcgccgtcgccaccgtcaccgaggccgtcgccgccgcgtgccgggactggggcttcntccaggtggtcaaccacggggtgcgcccccgagctgatgcgcgcggcgcgggaggcctggcgcggcttcttccgccgcccgcccgccgagaagcagcgctacgccaactcgccgcgcacgtacgagggcctacgggagcccccctccgggttgcaaaaggggccgccgttcttcgaactgggggggaacttactgggcgcggaccctcccccaccccaaaatttcatccaaggctccaaacccgaaatcttcccaattcccgatttcccaggtttctattcccatattccaaaacggccccc

SEQ ID NO: 88743 - protein, 200 aa, Zea mays
  misc_feature: Ceres CLONE 1576153
  misc_feature (100)..(100): Xaa is any aa, unknown, or other
MADCMQEWPEPVVRVQALAESGLSVIPSCYVKPPCDRPAPAPAPTMAPPAPAVHPRKKEPSSDAIASIPVVDLGELLAADGAVATVTEAVAAACRDWGFXQVVNHGVRPRADARGAGGLARLLPPPARREAALRQLAAHVRGPTGAPLRVAKGAAVLRTGGELTGRGPSPTPKFHPRLQTRNLPNSRFPRFLFPYSKTAP

SEQ ID NO: 88744 - DNA, 855 bp, Zea mays
  misc_feature: Ceres CLONE 1576155
  misc_feature: Encodes the peptide sequence at SEQ ID NO. 88745
ccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtcccctgctacttcaatgactcacagaggcaggccacaaaggatgctggggggattgcctggccttaatgggctgcgtatcatcaacgaggcaacagctgccgctatcgcccttgggtcttgaacagaaaggctacccattgtccggtgaaaagaaaggccccccttctttgaatcttgggagggtgggaccctttggaggtcctccctccctccccccttgggggggaagggaattcctttggggggtcc

SEQ ID NO: 88745 - protein, 171 aa, Zea mays
  misc_feature: Ceres CLONE 1576155
  misc_feature (9)..(172): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPCYFNDSQRQATKDAGGIAWP

SEQ ID NO: 88746 - DNA, 894 bp, Zea mays
  misc_feature: Ceres CLONE 1576157
  misc_feature: Encodes the peptide sequence at SEQ ID NO. 88747
  misc_feature (754)..(754): n is a, c, t, g, unknown, or other
ggagctccccgcggtggcggccgctctagaatagtggatcccccgggctgcaggaattcgtctcacccctagaaaaagtctcagttctcatgtccgggtgaagaaaagaaaaatcctcctgttccctgactatcgctacccctccacatccagtggccatggtgaagaagcccaacgacgttgccaaggccgcggcgacctccgccgacgcggcagccaggccatccaaggcgaatccgtccacccctcagtcggtcaagacctcgaagtttaagaagcggaaggtcaaggccaaccgccagaagccagcggtagctgccgcagctgttgacgatgtcgccccggtaggcgcaggcactggggatggcgatgcatctgcatccgcggttttaccgcacccacccaatgttgctgaggcatcgcctgtggtgcaaacgccaaagtcgaccgcttttgttgaggcgtcacctgtggtacagacgcagaagacagccactgatgctgaagtaccggtgcattcaccaatgccagccactgctgaagcatcagctttgtcgccaaggccaaagccaaaacagctcatgctaatgctgatgctgcagctgcaatttctgtcagcaagggcaaaggcgtgggtgctgataatagcggggggtgatggccgaatgaagagcagaaaaagagggctaggagtggcaaggggaaggaagttttgggggatggagaaaaataaaggggaaaggggaaagggttntgggaaataagtgtttggacaattaggaagaaaggggggactttttgggtcgagggttttctttttgtggccttggtctgtatataacacggggggaccgccaaaatgctattatggttatttttgggaaaataaataga

SEQ ID NO: 88747 - protein, 201 aa, Zea mays
  misc_feature: Ceres CLONE 1576157
  misc_feature (199)..(199): Xaa is any aa, unknown, or other
MVKKPNDVAKAAATSADAAARPSKANPSTPQSVKTSKFKKRKVKANRQKPAVAAAAVDDVAPVGAGTGDGDASASAVLPHPPNVAEASPVVQTPKSTAFVEASPVVQTQKTATDAEVPVHSPMPATAEASALSPRPKPKQLMLMLMLQLQFLSARAKAWVLIIAGGDGRMKSRKRGLGVARGRKFWGMEKNKGERGKGXGK

SEQ ID NO: 88748 - DNA, 789 bp, Zea mays
  misc_feature: Ceres CLONE 1576158
  misc_feature: Encodes the peptide sequence at SEQ ID NO. 88749
  misc_feature (500)..(500): n is a, c, t, g, unknown, or other
  misc_feature (662)..(662): n is a, c, t, g, unknown, or other
ctggagctccccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaaggggggagacctcgnagagtactggtggtgcaccgagcgctgcctcgactggggcgaagcgggcggccccgacctcatcgtcgacgacggcggcgacgccacgctgctcatccacgaaggtgtcaaggccggagaaggatacgagaagaccggcaagatccccgaccccgagatcancgaacaaccctgaagttcagatcgtggtccaccatcaatccgcgacggggctcaaggctgacccccaaaaaatccccccaaaaataaaggaaaaggttctctcggccttccctcaaggaaaaccccc

SEQ ID NO: 88749 - protein, 172 aa, Zea mays
  misc_feature: Ceres CLONE 1576158
  misc_feature (12)..(172): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (115)..(115): Xaa is any aa, unknown, or other
  misc_feature (169)..(169): Xaa is any aa, unknown, or other
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGGDLXEYWWCTERCLDWGEAGGPDLIVDDGGDATLLIHEGVKAGEGYEKTGKIPDPEIXEQP

SEQ ID NO: 88750 - DNA, 982 bp, Zea mays
  misc_feature: Ceres CLONE 1576159
  misc_feature: Encodes the peptide sequence at SEQ ID NO. 88751
  misc_feature (760)..(760): n is a, c, t, g, unknown, or other
  misc_feature (847)..(847): n is a, c, t, g, unknown, or other
  misc_feature (920)..(920): n is a, c, t, g, unknown, or other
  misc_feature (924)..(924): n is a, c, t, g, unknown, or other
  misc_feature (929)..(929): n is a, c, t, g, unknown, or other
  misc_feature (930)..(930): n is a, c, t, g, unknown, or other
ctccccgcggtggcggccgctctagaactagtggatcccccgggctgcaggaattcgtctcacccctagaaaaaaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcagggtaagaacaagcgctccgccgccgtccgtccgttggcgtcgtcaccgtccaaatcaaacaaaaagaactcggcgataatgtgtcgctttcgtaatgaacgcggggataagcgtggcccatggttttgggccgctgattttttttcgtgggcatgctagntggggggtggggggctgcaccgtgcccatgattcgaccgcgtcgcagtcctcggcgcgcaagtattcgatgcccatgtgctcatggncgacagatcatttttcgcccgtcgcgtcttgcgacggcgacagagagccagtgggggtctgggatagacatcngaantgacnngcttgtgatccttaagccatccatttctcgtcagctgcacggacgacaaata

SEQ ID NO: 88751 - protein, 173 aa, Zea mays
  misc_feature: Ceres CLONE 1576159
  misc_feature (10)..(135): Pfam Name: NAM Pfam Description: No apical meristem (NAM) protein
MSGAGPDLQLPPGFRFHPTDEELVMHYLCRRCAGLPIAVPIIAEIDLYKFDPWQLPRMALYGEKEWYFFSPRDRKYPNGSRPNRAAGAGYWKATGADKPVGTPKPLAIKKALVFYAGKAPKGEKTNWIMHEYRLADVDRSARKKNSLRVRTSAPPPSVRWRRHRPNQTKRTRR

SEQ ID NO: 88752 - DNA, 818 bp, Zea mays
  misc_feature: Ceres CLONE 1576160
  misc_feature: Encodes the peptide sequence at SEQ ID NO. 88753
  misc_feature (803)..(803): n is a, c, t, g, unknown, or other
gagctccccgcggtggcggccgctctagaactagtggatcccccgggctgcaggaattcgtctcacccctagaaaaactcgtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacaagcctatccggggtgatgtattcaaaacgtgatccaagcagccgcagggagtgaatctgctaacattttcataaaaaatcttggaacagacaatagacaaaaaaaacccttcatgaggaccttttccttcatttgggaaccatcccctcatggaaaaggagccgggggatgaaagcagggccaatccaaagggcttttgtttttgtttcagaatgaacaaaaangaaacttgccccaaa

SEQ ID NO: 88753 - protein, 112 aa, Zea mays
  misc_feature: Ceres CLONE 1576160
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNKPIRGDVFKT

SEQ ID NO: 88754 - DNA, 974 bp, Zea mays
  misc_feature: Ceres CLONE 1576169
  misc_feature: Encodes the peptide sequence at SEQ ID NO. 88755
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (726)..(726): n is a, c, t, g, unknown, or other
  misc_feature (727)..(727): n is a, c, t, g, unknown, or other
  misc_feature (730)..(730): n is a, c, t, g, unknown, or other
  misc_feature (731)..(731): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (940)..(940): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (955)..(955): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (972)..(972): n is a, c, t, g, unknown, or other
ctggagctccccgcggtggcggccgctctagaactagtggatcccccgggctgcaggaattcgtctcacccctagaaaaagtccctttcctatgttcctccagcggtccagcctagtagtttcttgctctgcaattcgccagttttgggctcctgatcgatcgaatcgtcgtcctggtggctcccatacagccggaccgcatggctgggcagcgctgggtcggtaaagtggcggctgctgctgttgtggcgctcttgctcctgtcgaccgctcttcccggaggagcacggagaggtacttcgatctcactcgtgccagattcctatggatgcgcagcggaatccatgcgctccggacgggctctgactagttattttgctcccagattgggggtttccatccccggattcccccatttgcctctctgctttcccagtcgtatcttgctaccgtgtgtttttaatgttaactaaagataagtaagaactgccttgtgtaaaccaactgctctaattatcacagaacccgatgtcaacaacaatggacggagttttgtttttaactatactctgaccaaagctgttgtggaatatgctgcagctgtaagttatttcaaagcccttcatttattttagcttaatgtgccatagtactagtttttttgtattttattttccccacatttttcttaagtgcttgttgacagannnnnnnnnnnnnnntttnnttnntnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnntatctntnnntnnnnnnnttnttnnnnttttnnnnntntt

SEQ ID NO: 88755 - protein, 90 aa, Zea mays
  misc_feature: Ceres CLONE 1576169
MAGQRWVGKVAAAAVVALLLLSTALPGGARRGTSISLVPDSYGCAAESMRSGRALTSYFAPRLGVSIPGFPHLPLCFPSRILLPCVFNVN

SEQ ID NO: 88756 - DNA, 1169 bp, Zea mays
  misc_feature: Ceres CLONE 1576172
  misc_feature: Encodes the peptide sequence at SEQ ID NO. 88757
  misc_feature (1)..(1): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (937)..(937): n is a, c, t, g, unknown, or other
nttgggggggcggggggccttttatctataaaaactagagtatcttccatgggaaccaccatcntnnnnnnaaaactggagctccccgcggtggcggccgctctagaactagtggatcccccgggctgcaggaattcgtctcacccctagaaaaaaaagagggaagccgcaggcagcatctgcatctctcgcccacctccgctccgcctactgctgctggtggtagggaggcggagaaagaggcccttgcgcccccccgccggccggatcagaaccgtaccaccacccacccatggggggaagtggcacaaacctttggtgcgccgtaaaaaggaaaaaagggtttgggggaacaaccttgggggaaatttccaataggaccctccgggagatcttccggggccctccccatttcccacctccgaaatttaacttccaaacaattttccctgggggaaaaaagggggggcccccccccaaaagatcgcccaaaaaaaaaggcccccccacaccagcccagataaaaaaaaaggtggcgaaaaagggccggctaaaacgcgggtctccccccctagaaaaacccccccaaaaaaaagggaccgggcctttttttttttttccaccccccccagaaaaaacccccccgcgggaaaacgcccctttgttgggggccccccccacccccaactgtggggaaatcaacataaacccgtggggggagaggggatttttttatgggggggggggggaacccactttatgttctccttcttctcacgggaaaaaaaaacctccctctgttgggagaattccgccccgcccgaaaactatcggagacttggtgtgttctccccccgaggggcgggagaaccccccccttcttgtgacaaaagaaagggggggggcgaaaaaaacacccccgggggcgctttctccngccccacagaaagaaacactctgcccgccctcgtgggggggggtggaatccccgcgaacgcctagtgagaacacccggcacactcaggggggggagggacatgaaaacaaacaggtgctttagggccctctgggcgggggggacccctccccccccccccatggggggcgttttttccgccgcacaaacaagtgttgtcctcaatatagggaggcggtttctcccccacccg

SEQ ID NO: 88757 - protein, 48 aa, Zea mays
  misc_feature: Ceres CLONE 1576172
  misc_feature (21)..(21): Xaa is any aa, unknown, or other
  misc_feature (22)..(22): Xaa is any aa, unknown, or other
  misc_feature (23)..(23): Xaa is any aa, unknown, or other
GGAGGLLSIKTRVSSMGTTIXXXKLELPAVAAALELVDPPGCRNSSHP

SEQ ID NO: 88758 - DNA, 845 bp, Zea mays
  misc_feature: Ceres CLONE 1576173
  misc_feature: Encodes the peptide sequence at SEQ ID NO. 88759
tggagctccccgcggtggcggccgctctagaactagtggatcccccgggctgcaggaattcgtctcacccctagaaaaaactcgacgcccagcaagcgctactactccaccaccaccactactttgcttgcttgcccctttcccttcccttctcacacgagaagagaagcgagtcggcgttcgcgtggcatatgcccgtgtctgccgccgggcttcgcctctagggtccgctccagcgccggccgaccgccatgggtgggctcgaggagatcaagaatgaagccgtcgatctgtccctttggccatgcccaccgtgctctcggtcaccatggccatcggctcgcacaagctgtcgcagcagggcgccatcaccaagaggatgaccgccatcgaggagatggccgggatggacgtgctctgcagcgacaagaccggcacgctcaccctcaacaagctcagcgtcgacaagaacctcgtcgaggtgttctgcaagggcgtcgacaaggaccacgtgctgctgctggccgcgagggcgtcgaggaccgagaaccaggacgccatcgacgccgccatggttggcatgcttgctgaccctaaggaggccagggctggtatcagggagatccacttcttgcccttcaaccctgtcgacaagaggactgctctgacgtacattgatgccgatggccactggcaccgtgtcagcaagggtgctcctgaacagattcttgacctgtgcccactgcagggaggatctgagcggaaggtgcacggtatcatcgacaagtatgccgagcgtggtcttcgttcgctttgctgtgccagacaggaagtgcctgagagaa

SEQ ID NO: 88759 - protein, 180 aa, Zea mays
  misc_feature: Ceres CLONE 1576173
  misc_feature: SWISSPROT Homolog: EC 3.6.3.6 Proton-exporting ATPase
MPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGHWHRVSKGAPEQILDLCPLQGGSERKVHGIIDKYAERGLRSLCCARQEVPER

SEQ ID NO: 88760 - DNA, 1151 bp, Zea mays
  misc_feature: Ceres CLONE 1576174
  misc_feature: Encodes the peptide sequence at SEQ ID NO. 88761
  misc_feature (54)..(54): n is a, c, t, g, unknown, or other
  misc_feature (55)..(55): n is a, c, t, g, unknown, or other
  misc_feature (62)..(62): n is a, c, t, g, unknown, or other
  misc_feature (63)..(63): n is a, c, t, g, unknown, or other
  misc_feature (913)..(913): n is a, c, t, g, unknown, or other
  misc_feature (997)..(997): n is a, c, t, g, unknown, or other
ttcccctgttgtctgctccttgctttacacgattgtttttatagaaggagtttnnttttttnnttctaatactggggctccccgcggtggcggccgctctttagtagtggatgacccgggctgcgtgtattaggctctcgcctagagagagaagaactcgattaagaagctcaccgcgtcgctgaagaagtacgcgcccgatagcgcccccgcgctcgccatcaacgcctccatcgagaagaccaagcgccggttcgagaactacggcaagttctggctgctgtgcggcgccgacggcctgacgcacctcatcgtcagcggcgaccagcggcactggggagagttcgtcaccccgggcctgctcttcctctacatcgccggctggatcgggtgggtcggcaagagctacctcatcgccatcagcggcgagaagaagcccgccatgagggagatcatcatcgacgtcaagccccccacccgcctcctccccagggggttcatctggcccgtcgccgcctaccgcgagctcatcaacggggacctcgtcgtcgacgacaaggacatcggctactactagctgcgcttgttcacctgcttgcaatgtggatatatattgctgctgccacactgggagcacttgggataggacgtgggtgaaacatgggatggccttttaggtgtaagaaggggcagtgctctgcctaaggggtatcctgggtcctgtctggacaatggaaagcccatggcctgtgtcttctgagggaaacttcggatgagtaccggtttgtgggtaacctccaggcatgctcccactcttatgcgtttcccccgtcaaggctgtaatgtgtgaaaaaacggaacttttcgcgagcgcagtggcttagagggcccactcctttgcaaggtacgaagntataggcccggccgcctctgtgaatggtgggctagcgtactcactgcgcccaacccagtgccttcccccggctgtagcccgcgntttggacttgtggtgttagaaactgcaataacaacggccgtgtggtctaaagaaatcagagatacttttgagataaggggggaacacacggcacggtaaccacggtataaagtccatatttcttggcggtggcaccagtgtggataatccaaaa

SEQ ID NO: 88761 - protein, 44 aa, Zea mays
  misc_feature: Ceres CLONE 1576174
MREIIIDVKPPTRLLPRGFIWPVAAYRELINGDLVVDDKDIGYY

SEQ ID NO: 88762 - DNA, 1064 bp, Zea mays
  misc_feature: Ceres CLONE 1576175
  misc_feature: Encodes the peptide sequence at SEQ ID NO. 88763
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (19)..(19): n is a, c, t, g, unknown, or other
  misc_feature (57)..(57): n is a, c, t, g, unknown, or other
tttttttttttnncncctntggtggggggtggtagttgtgttaggcttcatttttgntttggagaaaggtttttaattttttaaaactggagctccccgcggtggcggccgctctagactagtggatcccccgggctgcaggaattcgtctcacccctagaaaaactcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaacgaatgttgttttggagagcaaccatggttcctcctaaaattgttaacgatgggtgttacagtttgcccagagagggttgagcctggagggaccctggggggagaaaccatggggggcttaaaattgggttcaagggcaagccaggcaaggcctaaagaacccaatgggattccttaggcctggggaagaattggggggaacaaaacccaaccccctccctgggtgtggggtgtctctttggggccttccaagggaggggggcctgtggaaattccccccccttgtaaagaggggggggggtgtaaaaagagggggcttgggttgggggcccagaccccttggggggtgacccttaatactccgccgggggttctccagggaaattaaccttccccctcggggggatttccgaaggaaaaaaacacaagccggaaaaagaccccctcaagctgtggaaagaaaaccctaccccggaaagggtttggcccctaaagggagggggtcccaaaaaataatgtggaggccttgggcaaaaagtgtgcctccctcgggtatagagggggggggcaaccagaccacccaaaaatgggggaaaaaagga

SEQ ID NO: 88763 - protein, 81 aa, Zea mays
  misc_feature: Ceres CLONE 1576175
MASTFGATSTVGLMAAPTGKNVRLQRRVNFRVRAAKELYFNKDGSAIKKLQTGVNKLADLVGVTLGPKGTNVVLESNHGSS

SEQ ID NO: 88764 - DNA, 778 bp, Zea mays
  misc_feature: Ceres CLONE 1576180
  misc_feature: Encodes the peptide sequence at SEQ ID NO. 88765
ctccccgcggtggcggccgctctagaactagtggatcccccgggctgcaggaattcgtctcacccctagaaaaagccacaggcggcccttctccgcggaagccggcgggccgccgcctcccttacccctctcgctgtgctcctccgcaccgtcattccctagcattccccacgggcgaggtaaagaaacattctcccaccccctccagccccataggtgccaccgggatttctcttgcggttgcttggcccagatctgcggcgcattcggcgtttctgatctcgcgtgcacctcgtttccctcggcggtggatcagtggcggcttggtcgagatgggcgatgcggttgatgacatcatctgtgcaacggatgcggcggtcgccgtcgaggatgcggccagtgggaagcccgcaatgctctctagcttaggggggcagggtgaaggaagagcatgaggagaaggacaatgaggacaagtcaggcgagagcgaggtgatcaacccgccagaagacgctggcggggaggccacctcacccctggaagggttgaagcctcgcctttccaaggtgaaatcaagccatggacctaatgctgtcaaatcaaagagcccaacgagtggagacgaaggtcagaccgaggaaaaaagctcccaaattcttcctcttcctaaggcacccatttgtccaaggtgtccccatgggtgaaccctggggggtcgggcaggtaataaaagaggggcaaggattggggtcttcggctccattcttcccgggggaa

SEQ ID NO: 88765 - protein, 40 aa, Zea mays
  misc_feature: Ceres CLONE 1576180
MGDAVDDIICATDAAVAVEDAASGKPAMLSSLGGQGEGRA

SEQ ID NO: 88766 - DNA, 1247 bp, Zea mays
  misc_feature: Ceres CLONE 1576181
  misc_feature: Encodes the peptide sequence at SEQ ID NO. 88767
  misc_feature (26)..(26): n is a, c, t, g, unknown, or other
  misc_feature (44)..(44): n is a, c, t, g, unknown, or other
  misc_feature (867)..(867): n is a, c, t, g, unknown, or other
  misc_feature (869)..(869): n is a, c, t, g, unknown, or other
  misc_feature (1088)..(1088): n is a, c, t, g, unknown, or other
  misc_feature (1139)..(1139): n is a, c, t, g, unknown, or other
ttttttttttttttttttttttttangattggcggttttttttntctttcgtattgtttgatgatagattttatactggagctcccgcggtggcggccgctctagaactagtggatcccccgggctgcaggaattcgtctcacccctagaaaaaaccggccgctcccctagtccagcatgtacagctactatctgtactgggaggggaagtggtattggtggtcgtcggggtactggagcgaacctaacgatagcagacgttacccagcagttaatatagttatattaactaatgcctccttcaactatgcgttgggcatgagagcattagcccgaaccacctcaggacagctctgccgacggtgtgatcttgatcaaggatatggcggagtggcaaaagcactgggaacagaactgctccgaacaacaagcttgctggtgtaagaagttctacgaaaaagaattcccctccgctgtgccaaggccttgggaacaatccggttctgaaaaaaccttccccacagcaattacaaaaaggcagggggccaaactttccgggaaagctgtagggaacgttagaaccaaactttgtaaagccttttttgggcgcccggatattttccgcagaaatgagaaaaaggaagcgggtttacccggaaaagattttcgtggggcctgtggttccaaagaaagaatatggctctcctactaaaggtgggggtgtccctaaaaggggagcacctttttggcggcccccccccaaacaagaggggaggaggaaattgtgagaacctctcctttttgagaacatggagaggtgtattatgtttgttgttcccttaagacgagtaagaggggggggaatanantaaaataataaagagcgtctatgtgcgcaccacttatgggaggaggaatttataggctccctggcgtcagaatcgcaactctcttgcctggagaatgtattttaaaggttgtaatcaccctcttctcaatagtgtaaaaggccgcccgagggtctcatattgtctgcactaaaatcaaccgggttggggcggccacccaacgggaggaagcaactaatnatatctttcactccccctgagtatggggggtaggagcaaaattatctgctncgccgccaagagtgtgaggtcagagataaatataaatatgaggatgcacgcggcgtgtcgcttcgccgcacccgtgttaacggtacatatattatgagttgatctccg

SEQ ID NO: 88767 - protein, 88 aa, Zea mays
  misc_feature: Ceres CLONE 1576181
MYSYYLYWEGKWYWWSSGYWSEPNDSRRYPAVNIVILTNASFNYALGMRALARTTSGQLCRRCDLDQGYGGVAKALGTELLRTTSLLV

SEQ ID NO: 88768 - DNA, 841 bp, Zea mays
  misc_feature: Ceres CLONE 1576182
  misc_feature: Encodes the peptide sequence at SEQ ID NO. 88769
aagctggagctccccgcggtggcggccgctctagaactagtggatcccccgggctgcaggaattcgtctcacccctagaaaaagtcccttccgcaccctcctcttcaactccagccgctttcaccgccaatcagaggtccaccaccacatctcttcgcatccaaccgccccgtaggatcacagaaaacggggatggcgagcggcggggcggtgagggaggtgggctcggcggccgagctgcaggcggcggtggccggggcgcgggcggcggcggtgcacttctgggcgtcctggtgcgaggcgtccaagcagatggacgaggtcttcgcgcacctcgccgtcgacttcccccacgcggccttcctccgggttgaagctgaagaacaacctgaaatatcagaggcgtatggagttacagcggtgccatattttgttttctgcaaggaaggcaaaactgtcgatactttggagggagcaaacccagccagcttagccaataaggttgcaaaagtagctgggcctgctagtgttgctgagtctgctgtacctgctagccttggagttgctgctggacctgctgtacttgacaacatccaaaagatggcacagcgaaatggatcttctgctgttgaaagcataagctctggtagcacagaagatgcattgaataagcgattggagcagcttgtcaattcccatccccgtgtttttatttatgaaggggacccccagagcacccaaagtggtggtttcacccgtaaaagtgattgaacatttttgaaacaggaaaggggtggaaaatttggggagcttttgacatttccttaccagacaaatgaat

SEQ ID NO: 88769 - protein, 192 aa, Zea mays
  misc_feature: Ceres CLONE 1576182
  misc_feature (7)..(107): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASGGAVREVGSAAELQAAVAGARAAAVHFWASWCEASKQMDEVFAHLAVDFPHAAFLRVEAEEQPEISEAYGVTAVPYFVFCKEGKTVDTLEGANPASLANKVAKVAGPASVAESAVPASLGVAAGPAVLDNIQKMAQRNGSSAVESISSGSTEDALNKRLEQLVNSHPRVFIYEGDPQSTQSGGFTRKSD

SEQ ID NO: 88770 - DNA, 854 bp, Zea mays
  misc_feature: Ceres CLONE 1576183
  misc_feature: Encodes the peptide sequence at SEQ ID NO. 88771
  misc_feature (394)..(394): n is a, c, t, g, unknown, or other
ggagctccccgcggtggcggccgctctagaactagtggatcccccgggctgcaggaattcgtctcacccctagaaaaagcacagagtggtaagcatggcgagcaccacagacaaccgtggcctcctcctcgtcgtggccgccgccaccgtcgtcctcgccgtggccgcggccccggcgcatacaccggggggcaatactgctacccctccgccgccgttccggacggtgtacgcgttcggcgactcgttcacggacacggggaacacgcggtcgacgacggggccctactcattcggctacgtgtccagcccgccctacggcgccaccttcttccaccgctccaccaaccgctactccgacggccgcctggtggtggacttcctggccgaggcncacacactgcagtcctacctcccgccctacctcgacgtctccgtctccaacgccaaagccaacgccacggaggaccgagcccggcgtcaacttcgctgtggtcggggcccagggccattgagcacgaatttcttccgccggaacaaactccgggattaacgtaccgcccaaagtccatatgaacgcatttggggcctggtttcgaaacgcaacctgcaccggggcctgctacttcttccttcggccgccgcctggcggccaaaaggggttttttttggggggggggagaaatgggcgccaaacaaactaaccccttcaaaagtttttgccccccgaaaaacttttccttccccaaaaattggttcgccaccctgggggcaatccaaaaggggtaaccccctttttacaaagagggccttgggggagaaaaaagggcccaaaatacacggtaatttgtggg

SEQ ID NO: 88771 - protein, 152 aa, Zea mays
  misc_feature: Ceres CLONE 1576183
  misc_feature: SWISSPROT Homolog: EC 3.2.1.51 Alpha-L-fucosidase
MASTTDNRGLLLVVAAATVVLAVAAAPAHTPGGNTATPPPPFRTVYAFGDSFTDTGNTRSTTGPYSFGYVSSPPYGATFFHRSTNRYSDGRLVVDFLAEAHTLQSYLPPYLDVSVSNAKANATEDRARRQLRCGRGPGPLSTNFFRRNKLRD

SEQ ID NO: 88772 - DNA, 866 bp, Zea mays
  misc_feature: Ceres CLONE 1576184
tggagctccccgcggtggcggccgctctagaactagtggatcccccgggctgcaggaattcgtctcacccctagaaaaagattggatggtccctccggtcgaatctgccgctttccattatcgctgatgcaagatacattctctgtttattggaccttgccttcttggtacgccctactgcaatctctggttctgagactctgggcttagatgcagtaaggagtttgttggttttactttctcgacatgggtgtgagaaagagaaacacattggctggtgaggcagccgtaatcggcgcaaggtggtagccgtcactgcgtattggcatcggtctggttctcggagatggagttaactcgcccatgacgaatgatgggtagtatctgatgtaccaccccccccacgcgggtgcgatagccgtgttctacgcacacgggttctccttctactgtgtcttcctcgcctttgttgccgacgaacacgttccacaatcattggccgatgctaacaacacggaccttcattctgcggattgttctgctcggcataacgggagcggcacataaattctgggaaacgcagacggtatggcgagttcaataaaaaacttggaaaggctggtcaagaaacaaaagacagccccccggggaaacccataattaggggaaaaacatcatgggacgaagggcacatgagatgaaaacttatggcacagcctggaacacgtgaattaaactgaatcaggcggccctccaaagaaacaaaatccgccttccttgagccaaaaatatttccgggaaataatccccccttgaacaaaccacccaattcccgttggaattggaaagacccgggccttccatct

SEQ ID NO: 88773 - DNA, 885 bp, Zea mays
  misc_feature: Ceres CLONE 1576187
  misc_feature: Encodes the peptide sequence at SEQ ID NO. 88774
  misc_feature (810)..(810): n is a, c, t, g, unknown, or other
  misc_feature (845)..(845): n is a, c, t, g, unknown, or other
agctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagccccacccgcggtcgcacgtgcaggagtactggcggggtgtcgactttctgtcgcacctccccgagagcctgcacacctttctctttctcttcgacgacgtggggcgtgccgtccgactaccggcacatggaaagggtcgggcgtgaacacgtacacgttcctgagcgccggcgggaaaggcgcantacttggagtttcacttgaagcccacttgccggcntgcggggcatcttgaccgaaccacaggcacgccgaggcag

SEQ ID NO: 88774 - protein, 207 aa, Zea mays
  misc_feature: Ceres CLONE 1576187
  misc_feature (18)..(207): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPHPRSHVQEYWRGVDFLSHLPESLHTFLFLFDDVGRAVRLPAHGKGRA

SEQ ID NO: 88775 - DNA, 896 bp, Zea mays
  misc_feature: Ceres CLONE 1576191
  misc_feature: Encodes the peptide sequence at SEQ ID NO. 88776
ccccgcggtggcggccgctctagaactagtggatcccccgggctgcaggaattcgtctcacccctagaaaaaatgccacctcctgctccacatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtcgctgcaggccgccgccgccgcacctgccgccggcgcggtcgacgaggagactcctgcctcctcccctccgtcagatgctagcaagggggtggagaacctggtgatcatcggctctggaccagccgggtacaccgctgccatatacgccgcccgggcgaacctgaagcctgtcgtggttgcagggagacaaggtggggggtgttcccggcggggcagctgatgaccactaccgaggggggagaatttccctggctttccggacagtttaaccgggggcttgatctcctgggacggaatgcgctcagccaagcggaacgctgggggcgccagagctttacccaagaaggatggttgtagtttgttgaatgtaaaagagcatcccccgttttgttatttcctaagcaccgaacgcggagggcgaaaatgtcctaaccccaaatcattggccaacggggaggtacgggctaaaacgccctcccccttgccctgggggaagaagggatttttggaataaaaggccttcaggcggcatgtggcaaaatggggaaagggggctttcaccccctttttcaggggccacggttctttggcgtcttg

SEQ ID NO: 88776 - protein, 119 aa, Zea mays
  misc_feature: Ceres CLONE 1576191
MAVTRVAVAAALSAAPLSSRRHRVALPSACRLLPASATCCNSRAPMSLQAAAAAPAAGAVDEETPASSPPSDASKGVENLVIIGSGPAGYTAAIYAARANLKPVVVAGRQGGGCSRRGS

SEQ ID NO: 88777 - DNA, 856 bp, Zea mays
  misc_feature: Ceres CLONE 1576192
  misc_feature: Encodes the peptide sequence at SEQ ID NO. 88778
aagctggagctccccgcggtggcggccgctctagaactagtggatcccccgggctgcaggaattcgtctcacccctagaaaaactagaaaaacgcactctagcatcaggcatccatcggcgagagcgagagcgagagcgttcgcagcaagcctacctcacctcaccttgcctgcctgtctgtctgtctccagagctgctcttgtccggagacggagccgactgaacatggccggagacccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcgtacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcagcgagaggttccaggtggagggcatcccgcgcctggaggtgctcgctccggacggcggcgcggtggtacacccggacgccgccgacctcgtgcaccgctacggcgagagggcgtttcccgttcacggccgccaagggtggccggacctggaaggcggatgaaccaacggcaagtaccgcgttcccagaacgctgggaaaaagcctcttcttcccttcagccggggaaaaaagtaacgttggatgaaaacaaaggggtaaataaatgtgaaaaaagtgttccccggtccca

SEQ ID NO: 88778 - protein, 166 aa, Zea mays
  misc_feature: Ceres CLONE 1576192
MAGDPGDAPEVGGGGIRSVLTTASLVAPSGDEVQFREIDGKIIGLYFAANWYPKCEAFTPVLAAAYEQLKERGAGFEVVLVSCDEDRPSFERFHGTMPWPAVPFGDLSCKKRLSERFQVEGIPRLEVLAPDGGAVVHPDAADLVHRYGERAFPVHGRQGWPDLEGG

SEQ ID NO: 88779 - DNA, 815 bp, Zea mays
  misc_feature: Ceres CLONE 1576193
  misc_feature: Encodes the peptide sequence at SEQ ID NO. 88780
ctccccgcggtggcggccgctctagaactagtggatcccccgggctgcaggaattcgtctcacccctagaaaaaactgatagtctgatactgtctgtttcctctcgccttccactccctggatctccagttccaggctaggcccgagctggggaattccgatccccccaccaagggctcgccccgatcccaaggactcgtgcctctcgccctccgatgtggcaactcatcccatccggcttctaaagccgcggccaaggttgtcaattccggtggcaggcggcatggattccggcgccaatagcgtcggcgagtcggtgggcgagtcgccggtggccgcgccggcgcctcagacacggccagccgaaccggtcacaaagggccgcgggctccgccggtggcgtcgtatcccgcgcgagcagcaccacgaagggtctccggtgagccccgggctcggtaacagtgctggagctagcgcgggtgaagacttggcagcgcagctcccacagcgtcgttacggtcctgccgacgacaagcccaagggaaagcaagacgccgctgccaaagaggtggagagctcggtccccgtccgtgaaatcaaacttcgtgccgcctggaaggggtccccaccttcgcccgccaaacctgaactaggtgggaacccgaatctggggccccctggattgccaccacccggtttttccggtgggaagcccggcggggccccaattccgaacaaaaagccaatgtacccggccccaggaaaggtttttcccaggggccgccaaagggggccgcggggccacaaaatttttt

SEQ ID NO: 88780 - protein, 177 aa, Zea mays
  misc_feature: Ceres CLONE 1576193
MDSGANSVGESVGESPVAAPAPQTRPAEPVTKGRGLRRWRRIPREQHHEGSPVSPGLGNSAGASAGEDLAAQLPQRRYGPADDKPKGKQDAAAKEVESSVPVREIKLRAAWKGSPPSPAKPELGGNPNLGPPGLPPPGFSGGKPGGAPIPNKKPMYPAPGKVFPRGRQRGPRGHKIF

SEQ ID NO: 88781 - DNA, 1047 bp, Zea mays
  misc_feature: Ceres CLONE 1576202
  misc_feature: Encodes the peptide sequence at SEQ ID NO. 88782
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
gttgggtggtgnnnnntaggaaaatgggggggatagattataaaaagcggatggtgggggattggatttagttttttttattggagctccccgcggtggcggccgctctagaactagtggatcccccgggctgcttgaattcgtctcacccctagaaaaagcctttgtgcatcagctcaagggaagctttgcaaatattggtgctcacaaggttaagaacacttgcattcagttccgcgaattctgtcagcagaagagcacagatgggtgcctcaaggttctggagacaatgaggattaacttctatgaactgcgtggcaaatttcagacaatgcttcagctggagcgtcaggtcaatggctttccccccaacaagtaaaccagatggtggagtggaccttcatgttaggatgatgcttgcacctttcaagttgcagaacattctgaatgagctcatcaaatggtaatctggaggagagtcttgtaaccccccgaggcaggctaggatttagggcttgaacacccaaccggggaaccattaaggccatgtgccccttcaaagtaggttctctccccaaaaagggttggggtgacctcccgggttatatgtgtattcttccccttgcccatgccacaaatttttgccaaaggtccttttagccaaagactgggaggcctcgtggggtgttataaaaccccccccaagggggtgaaggggtaattatacaactttttgagaggcgagacgttaagacttcgcgcccctttcccttctaaaaattataaaaattgcgtgggtgccccatagaggaaaagtgccttaattttgggggtggggaaatatgttatcttagagttgcacattcccaaggttttctcccagggagaaattccccagtggcttgggtggacaaccccaaaaagaaaaaatggtctttttgggctcctatcggccttttaatataagtaaacaaggcctttgtggggggggttttggccccacaaataataagagggtaacacgtgctggttagcgaaaagcccaac

SEQ ID NO: 88782 - protein, 29 aa, Zea mays
  misc_feature: Ceres CLONE 1576202
MRINFYELRGKFQTMLQLERQVNGFPPNK

SEQ ID NO: 88783 - DNA, 809 bp, Zea mays
  misc_feature: Ceres CLONE 1576205
  misc_feature: Translation starting site: 198
  misc_feature: SWISSPROT Homolog: EC 1.4.1.2 Glutamate dehydrogenase
aaagctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattggcctatggtcttgacaagaaggcaaccagcgtccgggaagaggaatgccctcctca

SEQ ID NO: 88784 - DNA, 827 bp, Zea mays
  misc_feature: Ceres CLONE 1576207
  misc_feature: Encodes the peptide sequence at SEQ ID NO. 88785
  misc_feature (526)..(526): n is a, c, t, g, unknown, or other
  misc_feature (527)..(527): n is a, c, t, g, unknown, or other
  misc_feature (625)..(625): n is a, c, t, g, unknown, or other
ctggagctccccgcggtggcggccgctctagaactagtggatcccccgggctgcaggaattcgtctcacccctagaaaaaactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgaagcccaagaaccccaagccacccaagggcggcaccgggtacccggcgccagggcaccaaccgcccaagagcccctcctaccccccggtcgtcggccctcccaagggccccgtcacgcgcccgccagtcacgcgtccgccggtcgtcggtcctcccaagggccccgtcacgcgcccgccggtcacgcgtccgccgggtgtcggaccccacggtgactacccgnncgatcacggccctccgacgacgccgccctgtgtcggaacaccggtgaactacccgccgaatcacgggccctcaaacacggcgcctggttgtcggccancggtgaactacccaaccgatcactgggccgcccggaacgaaccccccggtcaccgggcccgcccgggacctacccaccccggggaaggcggggggaaattcaaacccctggcccggcgcccccaaaacccaaacccaaaacccctttttttcccaaaatgccccggggaattcccttaaaaattgggggccgtgggggggac

SEQ ID NO: 88785 - protein, 227 aa, Zea mays
  misc_feature: Ceres CLONE 1576207
  misc_feature (136)..(136): Xaa is any aa, unknown, or other
  misc_feature (169)..(169): Xaa is any aa, unknown, or other
MEGSSKKLQPFLLTLLLVLSTAVTPILSLSVPDDEVACDCDKPKAPKPSHPPKTKPSHPSPKPKNPKPPKGGTGYPAPGHQPPKSPSYPPVVGPPKGPVTRPPVTRPPVVGPPKGPVTRPPVTRPPGVGPHGDYPXDHGPPTTPPCVGTPVNYPPNHGPSNTAPGCRPXVNYPTDHWAARNEPPGHRARPGPTHPGEGGGKFKPLARRPQNPNPKPLFFPKCPGEFP

SEQ ID NO: 88786 - DNA, 1077 bp, Zea mays
  misc_feature: Ceres CLONE 1576211
  misc_feature (234)..(234): n is a, c, t, g, unknown, or other
  misc_feature (236)..(236): n is a, c, t, g, unknown, or other
  misc_feature (238)..(238): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (250)..(250): n is a, c, t, g, unknown, or other
  misc_feature (251)..(251): n is a, c, t, g, unknown, or other
  misc_feature (253)..(253): n is a, c, t, g, unknown, or other
  misc_feature (254)..(254): n is a, c, t, g, unknown, or other
  misc_feature (265)..(265): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (278)..(278): n is a, c, t, g, unknown, or other
  misc_feature (290)..(290): n is a, c, t, g, unknown, or other
  misc_feature (317)..(317): n is a, c, t, g, unknown, or other
  misc_feature (344)..(344): n is a, c, t, g, unknown, or other
  misc_feature (361)..(361): n is a, c, t, g, unknown, or other
  misc_feature (362)..(362): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (382)..(382): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (411)..(411): n is a, c, t, g, unknown, or other
  misc_feature (412)..(412): n is a, c, t, g, unknown, or other
  misc_feature (418)..(418): n is a, c, t, g, unknown, or other
  misc_feature (442)..(442): n is a, c, t, g, unknown, or other
  misc_feature (473)..(473): n is a, c, t, g, unknown, or other
  misc_feature (477)..(477): n is a, c, t, g, unknown, or other
  misc_feature (479)..(479): n is a, c, t, g, unknown, or other
  misc_feature (510)..(510): n is a, c, t, g, unknown, or other
  misc_feature (511)..(511): n is a, c, t, g, unknown, or other
  misc_feature (528)..(528): n is a, c, t, g, unknown, or other
  misc_feature (772)..(772): n is a, c, t, g, unknown, or other
ggagctccccgcggtggcggccgctctagaactagtggatcccccgggctgcaggaattcgtctcacccctagaaaaagttctcgcttctcttctcgtggatccccaaatcctctccggccaccggcatcgctcctctcccgcccgccgacgccgaccgctcctatccacgccaccgcgtcggtgctcgagttgcctcagagagggagagagagagagagagagggagggaggntntntnnntntttttnntnnttttttttttntnnnttttttttntttttttttttnttttttttttttttttttttttttttnttttttttttttttttttttttttttnttttttttttttttttnntttttttnnnnnnntttttntnnnnnnnnnntttttttttttgtggggnntttttngtggggttggttttgtgtgtgtgnggttggtttgggtgtgggggggggttttgtntggncngttgggtgttttgtggtttgtgttttttttnngttttttttttcccgcntgggtgtttttttgtgtgggtattttgtggggcgcttgggggcgctcttctcttgttgttgtcccgcgtgttttttgtcgttgcgccccccctgttttggtccgcgccctgtcggccgtctgtgcctttttcgccgtctgttgcccgcgcccttcctgtgtcgcttgggatgtggtttgcccccgcttggttgtcgcgtcgcctttttttttgttctctcccctggtgtacggtcgcggtcggnctctagtgtttgccgcccccccgttgtatgtattttgccccccccgtgtgttgagtgcgcgtcatgtttagataccgcatggcgtcccatttgtattgccaggcgccggcgcgcgcccttatttgatgggtgtcgagaagcgatagttatcgcaagtgacacgtgcgccgcccatagatgcggcagcgtaggagtaggggagaatcgacgttatgagcgcattaccccccacactggcgccgttgtatatagatatagcgcgaggggcgcccccctgttaatgtgtgaacggtgtgacattgaat

SEQ ID NO: 88787 - DNA, 1223 bp, Zea mays
  misc_feature: Ceres CLONE 1576217
  misc_feature: Encodes the peptide sequence at SEQ ID NO. 88788
  misc_feature (24)..(24): n is a, c, t, g, unknown, or other
  misc_feature (66)..(66): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
tatgtggcgggaccaaaacccctntctatcatttcttaacaaaaacacccccccacccccaccccnttctnnnaaattggggctcaccgcggtggcggccgctctagactagtggatcccccgggctgcaggaattcgtctcacccctagaaaaaaactcgtccactcaccccctctttgctctgcctcgccgcgccgcacagcagagcatgtcgcccccacgccctctcctcgccgccgtcttcctcgccgcggcggttctgctcctcctttctccggcagaggcggggacggtgggcgtgaactacggccgcggggcgaacaacctgcccaacccagcggcggatgtgcagctgctcaaccagcagggcgttccgcaggggaaatctgtacgacgccgaccccaccgagtctgcgcgccctcgcaaacaccggtcatgaaggtgggggggggggcttgccctaccaagcatggcagcggttggccccccccgcgccacttacctactcggctgcagatggggggtccccagaaccctcgccggtgggacgaacactgggccaccgcaggattccaagggtgattcttcccgtgggggccaaacgtaggtgtacccgtcgggttctggcctaagcaacactagtgacgcggctcccatcttcgggtcctgcgggagcagggggagccgaagctgcctcagcgccggcccgcaattggggaggctggggctgttggtgtcttattgaacaacgcggaaacccacacccacaatggtgtgtcgtcgtttcgacatctcccgacaatctgagggactccgctagcggtgcaccccgacctcggcggacatgagtcctatatagacccggtgtcgcctttcgtggatgcgggtgggcgggatgttatacactacgcggaagctgtaaaaccatacgcggagactaaagagaccacttctccctaatacaagcacccccataacggagtccgacacaccatgtctgcgtcccgtgcgtccaaacaatctcacacggtgtcgctcaccacttaatgtgagtgggtccaaaatagtctatctgtcagaagtatctccttttatgagaacaattaatgccctccgcattgaccgtacggtgtggtacaacatgaatggcccagactgtggccatcacgaagacatctccacgatatgacagggccggggccgtattatgcttgtgtccgg

SEQ ID NO: 88788 - protein, 124 aa, Zea mays
  misc_feature: Ceres CLONE 1576217
MSPPRPLLAAVFLAAAVLLLLSPAEAGTVGVNYGRGANNLPNPAADVQLLNQQGVPQGKSVRRRPHRVCAPSQTPVMKVGGGACPTKHGSGWPPPRHLPTRLQMGGPQNPRRWDEHWATAGFQG

SEQ ID NO: 88789 - DNA, 948 bp, Zea mays
  misc_feature: Ceres CLONE 1576223
  misc_feature: Encodes the peptide sequence at SEQ ID NO. 88790
  misc_feature (623)..(623): n is a, c, t, g, unknown, or other
ctggagctcaccgcggtggcggccgctctagaactagtggatcccccgggctgcaggaattcgtctcacccctagaaaaagggcccagttatcaaggtgattgtgtgaagtgtagagcgcccacctccgtcagctgggcacacgtagatatagcagtagcagcagcggagctgttcgacgaaatgccgccatggccgccgtgtctccagcctaccctcaccaccgctcgccgcgccaccgtattctccaggacgagatgtctctcttctacccccgcctctcctacctacgagcaggggcagcacgaggaggagccatcgttggtcgttgtggggggcggcgcggcgggcgtgtacgcctccataagggccaagacccttgctccgcacctcaacgtccccccccaggagaaaggcaggttctttgtccaaggtccagatctccggcggtgggccgctgccaacgtaaccaatgggccattcaccttgaagcccatgggaactggcgaagaaatttttcccaaggggggaaacaaaggaccctcccgaaggattcctttcttttacccgccccaccgggcccgccaggaatacccatgccccctgggttcccaaaaattaccngggggtaaaagcctttaaaaaccgggagggaccaaatgggcaaaaatcccttccccgggtcacgggaaaaaaatttaaccctttccaagttgttaaaaaacgggcctcccttggaacaaaaaacaaaaaaagggtctgggggggtgttcctcctggccgggggccgggaaagaaaacggggggcttcgagggggaaccgtgtgtggccccaaaaaaagggggaaaaatttttttccctcccagggggggagaaaaaaactttcttggcgcaatatattttggtgttatttatatataagccccacaataaaaacttgcgggtggg

SEQ ID NO: 88790 - protein, 152 aa, Zea mays
  misc_feature: Ceres CLONE 1576223
MPPWPPCLQPTLTTARRATVFSRTRCLSSTPASPTYEQGQHEEEPSLVVVGGGAAGVYASIRAKTLAPHLNVPPQEKGRFFVQGPDLRRWAAANVTNGPFTLKPMGTGEEIFPKGGNKGPSRRIPFFYPPHRARQEYPCPLGSQKLPGGKSL

SEQ ID NO: 88791 - DNA, 978 bp, Zea mays
  misc_feature: Ceres CLONE 1576224
  misc_feature: Encodes the peptide sequence at SEQ ID NO. 88792
ctggagctccccgcggtggcggccgctctagaactagtggatcccccgggctgcaggaattcgtctcacccctagaaaaaaggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgccaagccgtcgtccgccgtctcgcagcagcaggccggggccgccgccactgtcactgccgccgccgccttcaagaccggcgccgccatccctgacgccggcggccggaccgttgtgtgcgacatgcacggcgccctgctgcgctccaccgcgctcttcccctacttcatgctcgtggcctgcgagggcggcagcctcgtccgcgccatgctgctgctctgcgccttccccctcgtctgggcgctcggggagcgccgcggcgccggcgtccgggtgatggcgttctccaccttccgggggctcagcccagggacctgggactcgtgccccgcgccgtcccgcccaagaacttctgggagcatctcaaccgcctggggtacggaaacctcttggtcccggccaggaagaaaggtgggggtaacccggggcgccccggggcatttgccaatgggtccccaaaggaatacttggcccccaaaccggtggttggggctctagatgtcaaaacaggaaattttggcccgccccggggattttacgggggtggctggtgggggcccggcccccccgcggggaaaaggactttaaagaaagggggctcctccgagggtggttttatggccacacaaaacaccacccttgggcggtggggggctacaagaaagaaccccccc

SEQ ID NO: 88792 - protein, 203 aa, Zea mays
  misc_feature: Ceres CLONE 1576224
  misc_feature: SWISSPROT Homolog: EC 2.3.1.15 Glycerol-3-phosphate O-acyltransferase
MVFPAILPKVAARWLFTFYRAARKLRRHAFQLYYRNTAAKPSSAVSQQQAGAAATVTAAAAFKTGAAIPDAGGRTVVCDMHGALLRSTALFPYFMLVACEGGSLVRAMLLLCAFPLVWALGERRGAGVRVMAFSTFRGLSPGTWDSCPAPSRPRTSGSISTAWGTETSWSRPGRKVGVTRGAPGHLPMGPQRNTWPPNRWLGL

SEQ ID NO: 88793 - DNA, 1265 bp, Zea mays
  misc_feature: Ceres CLONE 1576228
  misc_feature: Encodes the peptide sequence at SEQ ID NO. 88794
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (482)..(482): n is a, c, t, g, unknown, or other
  misc_feature (697)..(697): n is a, c, t, g, unknown, or other
  misc_feature (959)..(959): n is a, c, t, g, unknown, or other
  misc_feature (998)..(998): n is a, c, t, g, unknown, or other
  misc_feature (1265)..(1265): n is a, c, t, g, unknown, or other
ccaccaacgaacctagggagcacgcataaaaatttnnacaangaaaggtccttaaatannnntatatnnnnnaaaactggagctccccgcggtggcggccgctctagaactagtggatcccccgggctgcaggaattcgtctcacccctagaaaaacgaagaatcaagcagctaccatcatcagtccagcaacaatggcggcggcggaaccggtaccagtaccagtaccggcggcagctgccgggaccaacaataagatcaagacggtggtggtgctggtgcaggagaaccgctccttctaccacatgctggggtggatgaagtcgctgaacccggacatcgacggcgtgacgggggccgagaccaaccacgtggacgcctccgacccggcctcccgcgccgtccgcttcagcgacggcgccgagtacgtggacccggacccgggccactccatgcaggccatctacaagtgggcccccccnaaggccttagtcgaagccgccacgacgcccgtcaacccgccggggggtctcccccctccatgttccggctttctccccactcaggcccgagaaatgaagagggcccggggcatgttcccgcccacacgtcaatgagcccgggcttccccccccccgacccgccggtgaccacggggtgaccccggggaaccctcggtggcgggggagagttgcgncccatagtttgggggatatcggggtagggcttttttgcggggacactaaaaacctcgggggagcgttgtcacatcgtccctatgtcgcgcaaaacacccgcacgagatttgagatgcacagggcggccgagcctccttccctgagaccaccagaaggttagtgttctcgagacgggaggggctctttccttcgagtcaagcctcaaacagcaaagatcgaaaattgctcaggggggtcgcgcctcctctcggtctgtgtggnttggatggatactccttacttctcttcttatcggggctngaacctccacgcatccgtatatctggagacgaacttgcggtgtccccaacgggtgttcgcgaatgagtgtcccctctcattctgatcggtctcagcgaatagtatgtataaactatatcactgcaagcatcatatccagacgtctgatagtacaacagggcgtccgcattatttcataccgctgagaggagcgccctccgccgcaccacagtcctctcatgtttgaccctgccggcccgcgcgatattgcttggccacggctctttn

SEQ ID NO: 88794 - protein, 140 aa, Zea mays
  misc_feature: Ceres CLONE 1576228
MAAAEPVPVPVPAAAAGTNNKIKTVVVLVQENRSFYHMLGWMKSLNPDIDGVTGAETNHVDASDPASRAVRFSDGAEYVDPDPGHSMQAIYKWAPPKALVEAATTPVNPPGGLPPPCSGFLPTQAREMKRARGMFPPTRQ

SEQ ID NO: 88795 - DNA, 1131 bp, Zea mays
  misc_feature: Ceres CLONE 1576229
  misc_feature: Encodes the peptide sequence at SEQ ID NO. 88796
  misc_feature (1131)..(1131): n is a, c, t, g, unknown, or other
gagctccccgcggtggcggccgctttagaactagtggatcccccgggctgcaggaattcgtctcacccctagaaaaagtgtggctcgtgtggctggctgtgtcctccatcctttcaaggacctcgggaatccagaaaattccggtgtcggtgcccacggacaggcgtgtgcgccacgagcccgacgaacaagggaacgaggctatttccaccggtcaaactaggagaagcaagcaaagctccccaccattagcagaatccgcccgaagtctgccccgctcttcggcctcgtcccttctctccagggccatggatgtagatgatgtgctcagtaacttgcgtgttgttggtgtgccaacaaagagtgcaatttacatatggggttataaccacagtggccaaactgcccgaaaggggaaagaatggccacttgaggatccccaaggagcctcccctccccaacctattcaaaattgggggaatggggaaaaagcctccaggtgggaaccgatatttgcattgtgggcccgtgtagcataaccgccttccaagttggctttcccaaagggatcaccttgtttccaccccgtgggggggcttaaatgaagtttttgggcccacgtttgggggaagaatggggaccacgaagtgaaacagcccgccgaaaaaagaacgcccccaaaaaaggggtgccaagggccccttctgtgagaaaacctggaagtttttcggtataaaaaatcaaagttaatccccggggaggagccgccacaattttggtataaaaagtctggcgccgcttccgttgaaaaccctccgcgaaaaaaaacgaaagtgggcccgggtgtttcttaaaaaaaccggggttttttgggggttgtggggggaaacaatactcgagggtctcaatatataccccccgcccctttttgtggggggagctctttcaccaccaaaacgggtgtattttcacaaattttttttggggagaagtgtgatagtgggagggccctcctccagagggtgtcccctggcagacctgggggtttcctggggatggagaaaacagggggcccgtgtggcatctccccccccctggtgagaaagggggctcccctcgggaagggcggtn

SEQ ID NO: 88796 - protein, 76 aa, Zea mays
  misc_feature: Ceres CLONE 1576229
MDVDDVLSNLRVVGVPTKSAIYIWGYNHSGQTARKGKEWPLEDPQGASPPQPIQNWGNGEKASRWEPIFALWARVA

SEQ ID NO: 88797 - DNA, 958 bp, Zea mays
  misc_feature: Ceres CLONE 1576231
  misc_feature: Encodes the peptide sequence at SEQ ID NO. 88798
  misc_feature (774)..(774): n is a, c, t, g, unknown, or other
  misc_feature (785)..(785): n is a, c, t, g, unknown, or other
  misc_feature (799)..(799): n is a, c, t, g, unknown, or other
  misc_feature (883)..(883): n is a, c, t, g, unknown, or other
aaagctggagctccccgcggtggcggccgctctagaactagtggatcccccgggctgcaggaattcgtctcacccctagaaaaagtccgcaccacggcgtcagactcagacccttcacattcccagttccctctgcgccccgtaaaccctagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcatgagaaccctgtgcctgtggttcagaagaaggctgcggcggcggccgtgttgtccaaggcagagcaggaaaggaagagacccccctcggatcctgctcctaccgggaaggcaaaaaagatgaaggctgtggctacccctcttgccaaggcgaagaagggcaaggccgagctagagaagccggcgcctgaggccactccagcaggatatgcaaagaagggcaaagctgagctagagaagccgacgtttgatgccattccagcaggaaaggcgaagaagggcatggccaagggagcagctccctgaggcacgccctcanggcaggggaangaaagatggggacnaactagagaagtcagcagcgctagatccctcacattcagacagcaagtctgagaagcctgtgcgccccacatggggaaagatgnatgaaattgaaaattttggaggccctgctgcgcatgtcaggcgtgagggtgagctgccaaggctgatttacctct

SEQ ID NO: 88798 - protein, 199 aa, Zea mays
  misc_feature: Ceres CLONE 1576231
MARKRRAPSPPPPPQEESSSEESGSEELEEPPRLPELRSPPQAAANNADSSEADTDSDTDAQAFQMRQVPRSLTKHTHPVPQPESDPEEEEGESSESEHENPVPVVQKKAAAAAVLSKAEQERKRPPSDPAPTGKAKKMKAVATPLAKAKKGKAELEKPAPEATPAGYAKKGKAELEKPTFDAIPAGKAKKGMAKGAAP

SEQ ID NO: 88799 - DNA, 1252 bp, Zea mays
  misc_feature: Ceres CLONE 1576234
  misc_feature (53)..(53): n is a, c, t, g, unknown, or other
  misc_feature (58)..(58): n is a, c, t, g, unknown, or other
  misc_feature (62)..(62): n is a, c, t, g, unknown, or other
ggaagggttaatgaagtagtctacaaacacaaaaatcgctttgcttagggttntaaanactntttttttaaagctggactccccgcggtggcggccgctctagactagtggatcccccgggctgcaggaattcgtctcacccctagaaaaaattacctggacggggtcaacgggctatcaagaaggcccgtggcctaagacaatggcccacattgcagttggagggtgagtcggcttaccctctccccaagtgggagagtgcacgacattatttcatgctagagggggtatccgtacgcgcgggcacctgcgctgaccaagagacccgccagcgttacaggcttccaccaatcaccccggcgccctcgaatccccgcggggccgccgccctcaatttccctccgatgccgaactgctcctctcctcggagccgccctcggttatgaaatcttcccggatccgtaaggatggcagatagcccttgaaactccccagcaactttgataattttggaaaattacccaacctggatcaaggggatattcaaaccaccccatagggacaggggcattcaggtcaggatactcccccaaaagcactacctcaccacccagaatccgggctttactccagaggaggtcctaagaaactgtaaagggtagaatcgcattcaaggggaaacctgccactcagaccagactttctgtgggaaggtctccaacccttaaaaatctggaataaaaaaaatagtggcctagtccagcagggaatcaattgcacaacaagctactggtttcacaaaatctagggaggggtgtccggcgagagcttttctcgttttctagaatctaaagaaagcggtccgccgctccggctaaaagcggagtgataatgttgaaatgggacgggggatatttacaaattttgagaaataatttgatcggagtgttgtaccccgcctgtaggcgcgtgtggtccccacaagggataaaatatcggaggggcggtttcaccttgttatttgcacatacgctttggataagtccaaatgattttgaagagctgtatatctttctcgacgtgatagtgatcacaatatcctgttgtgtcctttgtgggaaaagataataacagccagggtgtcgacggcgccgagtggcaaggtgggcagtgttttggatatgtggagaccttcttttggggtaagaggattatggaatgaatatacaatttattgtcgcgatgtctctac

SEQ ID NO: 88800 - DNA, 801 bp, Zea mays
  misc_feature: Ceres CLONE 1576235
  misc_feature (735)..(735): n is a, c, t, g, unknown, or other
agctccccgcggtggcggccgctctacattagtggatcctacgggcgtgaggtattcgtctcaccggtacacaacttcactcaccccggctgcttctcctgcctggtaccaccacgtgccaatggtgcaccttaccatggcagaccgccactgtgggccccctccacactgtctgcccccgcgaccggcgctcccgcactctctgcgtcccctccgtcctgtacaacctggtcttcctcggcgagttcacgcccgcttattggtacatgtcccatacctcgcatacggtggcacgagttccccgatgcaggcagggccatcgtgggctacccgatgtgcgccttcgacaagcccgggaaccacatcgtcgaggtgctcacgaagctctcgctccccaaccggtccttgcttctggcgcagcttgcccgcccggccactacgcgactgcctcttctgccagccagtgcgccacggcccgagtttgctcaagatccggaacctcatcaagagcgatggcgtggtgggtgtgtctcaactgcctaagagacgggtggagccacgagacctaacagatgcgcgtgcacgacccctcatcgggatcactgaccggcatcttgcgtgccaacgacttcggatccatcatgctcgtcgctagcttacagtattgggatgatacaaggtacaccgctcttggatgaaggaccacatctctgcgagctattgacatacttgccncgtgcgtcatcggcagctgcgccaatgacagctatggaccctgatcgcaagaatgcaagtgtgttt

SEQ ID NO: 88801 - DNA, 934 bp, Zea mays
  misc_feature: Ceres CLONE 1576236
  misc_feature: Encodes the peptide sequence at SEQ ID NO. 88802
  misc_feature (810)..(810): n is a, c, t, g, unknown, or other
aagctggagctccccgcggtggcggccgctctagaactagtggatcccccgggctgcaggaattcgtctcacccctagaaaaaacaagtaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttgggatgggatccagcagcgcaagaattgctggcaggatggggttctcggcaccacctgccccataccgccaggttggaactggacctacaacttccaggtcaaggaccagattggcagcttcttctacttcccaccccttggtatgcagcgtgccgcgggggggttcggaggtatcactgtcaacaaccgcgcggtcatctcggtcccattcgacacgcccgatggggacatcacgctcttcatcggggactggtacaagatgaaccacacgcacctggagaagatgctcgacgacggcaaggaactggggatgccagacagggttttgatgaatggaaggggccatataagtataatgactcgctagtgccagatggccttgagcacgagactatcaaaagttgagccctgaataacattaccggtttccgtgtccaanattgttggtggtctccacaagccttgaactttcgggattccgaatcacaacactgtgccccttggttgtaaacagaaaggttcattacgcgatgtaagacagaaatttttcctgaatcgccgat

SEQ ID NO: 88802 - protein, 203 aa, Zea mays
  misc_feature: Ceres CLONE 1576236
  misc_feature (31)..(147): Pfam Name: Cu-oxidase_3 Pfam Description: Multicopper oxidase
  misc_feature: SWISSPROT Homolog: EC 1.10.3.3 L-ascorbate oxidase
MGPPFLAVAVIVAFLAAAAQAADPFAFFDWDVSYITASPLGVPQQVIAVNKQFPGPIMNVTTNYNVVVNVLNSLDEPLLITWDGIQQRKNCWQDGVLGTTCPIPPGWNWTYNFQVKDQIGSFFYFPPLGMQRAAGGFGGITVNNRAVISVPFDTPDGDITLFIGDWYKMNHTHLEKMLDDGKELGMPDRVLMNGRGHISIMTR

SEQ ID NO: 88803 - DNA, 1158 bp, Zea mays
  misc_feature: Ceres CLONE 1576238
  misc_feature: Encodes the peptide sequence at SEQ ID NO. 88804
  misc_feature (14)..(14): n is a, c, t, g, unknown, or other
  misc_feature (15)..(15): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (76)..(76): n is a, c, t, g, unknown, or other
  misc_feature (77)..(77): n is a, c, t, g, unknown, or other
gtggttgtgtggtnnttttttattattcttaatgattatgatgctaatttttcactctttatatnnngnagatganntgttaaaactggagctccccgcggtggcggccgctctagaatagtggatcccccgggctgcaggaattcgtctcacccctagaaaaaaagctcatgcagagctttaagtccaaggagtatgttagggagaccttctcctggcagtactactactggtacctcaccaacgatggcattgagcacctacgcaactacctgaacctccggtctgagatcgtgcctgccacgctcaagaagtctgccaagccaccgggccgcccatttggctctggccctcctggtgaccgcccaagggagaggcgagatcttgtttggggaagacgggaagagatgaggggctaaagttcgccacctggttttgtgcttcttcaggtttattgcctccattcacttaacggcttaaactacccaattttttgcaatttagtcattttcttcgaagaaaaaaaatcaaggtttccagctggacttccgagcaggtgtttccaggatccattggataggtttggtacatcggtatttcctcaagggcctcccccaactgaaccgcttctggaaggcctaatcgaaaggttggtaagctcggaccggaaaatatttttccaccatgggccccgagccaagacccaacccgtaaattttataagctttgcgcgatgcttgtcccgggcgctttgagcactctttttatcaacaaaatttaccacccctttctctgtgtcaagagggggtaacaccccaatttatttgaagtttttggtatttttcactctatcacaggggggggtacgcccaatgcctgatgggtgttattttcctaagcctcttgcgcgcgtttactaggggtgctataaaacgcggtcaccaacatggtaaacgagacgagatgagaagaaacatttgtatttggcccaccctccaatattgggttcccccacgcggggggtaaacagaagaggcgttattataaaaactactaactcccgccggtggagagcaccccagaaacagatgaaaagtaatggggggatatttttagcccacgcgatattacagagaaatttcaataacacattcgcaa

SEQ ID NO: 88804 - protein, 82 aa, Zea mays
  misc_feature: Ceres CLONE 1576238
  misc_feature (1)..(53): Pfam Name: S10_plectin Pfam Description: Plectin/S10 domain
MQSFKSKEYVRETFSWQYYYWYLTNDGIEHLRNYLNLRSEIVPATLKKSAKPPGRPFGSGPPGDRPRERRDLVWGRREEMRG

SEQ ID NO: 88805 - DNA, 813 bp, Zea mays
  misc_feature: Ceres CLONE 1576240
  misc_feature: SWISSPROT Homolog: EC 5.4.2.2 Phosphoglucomutase
  misc_feature (742)..(742): n is a, c, t, g, unknown, or other
ctccccgcggtggcggccgctctagaactagtggatcccccgggctgcaggaattcgtctcacccctagaaaaagatcacttctctcccgacactctctcactcccgtgtcgtgtctagcgccgacggcgttgctaccggagccggccagcggccacgatgcctacaatgcacgcgcttcgcctatgcccgctgctctccaccatccgatccacaccaccgcgggccactgccgcagcccgccagggcgcgctcttcgtcgcccgctgctcctccgccgggacgccgtcagccgcccaggcgctcaaggaatgtgcctgaagaagtgaagctgatgctattcgctagtctttctgtggaggatgaagatcagttcaatcccgaccaagccagttgaggggcagaagactgggactagtggcctgaggaaaaaggttctccatttgattgcttccgagctatgcagatttagtagtatattttattcctctggaaaacattgctgtacaggttcctgtatggtgacacataatggattgcgatagcattctgtgctgttcttttcaggtgaaagtattccagcaggagaactaccttgctaattggattcaggctctattcaattccttgccccctgaagattatgtgggtgcaacccttgtacttgggggtgatgggcggtactttaacaggaggctgctcagatcatcattaagattgcagctgggaaatggagttcaaangatcatagttggcagggaatgtctactgtcaacacctgctggatctggctgtaattccgtaaaagaaaaat

SEQ ID NO: 88806 - DNA, 844 bp, Zea mays
  misc_feature: Ceres CLONE 1576247
  misc_feature: Encodes the peptide sequence at SEQ ID NO. 88807
ctccccgcggtggcggccgctctagaactagtggatcccccgggctgcaggaattcgtctcacccctagaaaaacccggcgacggggatcctgcactcttgggttcttgcatcccgcataccctcgaaagctcgaaagatcccgcggcgcagcagccacccttctctcctctccgctcccaatcttatcgtcgcctccctcgaagtcgccgctgccttcattccaccatggcgcttcacgccccggtcctcgtgatgaaggactcgctgaagcgggagtctggcgcgaaggttcaccaagctaacatccaggcggccaaggctgttgctgacatcattcgcaccacaatgggtcccaatatcatgctgaaaaatgctatctggacgcttggccccaagaattgtgggttactaaatggaggggaaattctatttttgaggggggaaattaaaatttcgcaaaacccctgggttgcccagagtctttggaattggaaaccaaaagtccgttacccccaaaaattgaaaaaaaattttggggggagatggggccaccaaaacccactcgtggggcaatttgggttttccaaaccctggggagaaaaaaaatcccttacccccggttttgtgcccacggggggcttttttttttgtgggacaaaaagaaaatatcccccccccccaaaggggggtgtttttttggggggggggggatatcccccccccaagaaacccttgtggagggagggagccgtttttgggggggggacctctgggaacaaaaaatatttcccaaatccccgctgtttaaaagaggaaaaaaataatccggggggggggaaata

SEQ ID NO: 88807 - protein, 205 aa, Zea mays
  misc_feature: Ceres CLONE 1576247
MALHAPVLVMKDSLKRESGAKVHQANIQAAKAVADIIRTTMGPNIMLKNAIWTLGPKNCGLLNGGEILFLRGEIKISQNPWVAQSLWNWKPKVRYPQKLKKNFGGRWGHQNPLVGQFGFSKPWGEKKSLTPGFVPTGGFFFCGTKRKYPPPPKGGVFLGGGGYPPPKKPLWREGAVFGGGTSGNKKYFPNPRCLKEEKNNPGGGK

SEQ ID NO: 88808 - DNA, 790 bp, Zea mays
  misc_feature: Ceres CLONE 1576249
  misc_feature: Encodes the peptide sequence at SEQ ID NO. 88809
  misc_feature (700)..(700): n is a, c, t, g, unknown, or other
ctccccgcggtggcggccgctctagaactagtggatcccccgggctgcaggaattcgtctcacccctagaaaaactctttcttcttcttcttcctcttcgcctgctcggtcggctactcctactgtccggggaacccagcccagcccccgagccccacaccacacacagggttgcccacccacgccacgcacgcgcagccgcggcggaagccacccacccgggggtgggctccgatgggttgctgcggctcctcgcagcgggcggggacgcacccggagaagaagccgccgggggcgctccccccgcaccgtccctcctactcgctcaaccagcaccaggcgccgccgccgccgcctccctccgcggctcgcgccggcgcccgccaggtgccgccgctcaaggagttctcgctcgcggagctgcgcgccgccacggccggcttcgcggcggggaacatcgtgtcggagagcggcgagaaggcgcccaatttcgtgtacaggggccgcctcgaggccggccgccgcgcgatcgccgtcaagaagttcaccaagatggcgtggcccgatcccaagcagttcgcggaggaggccaagggggtcgggaagctgcgccactgccgcctggccaacctcatcggctactgctgcgacggggacgagcgcctgctcgtcgccgagttcatgcccaacgacacgctcngcaagcacctcttccactgggaaaaccagacaattgatggggctatggcgtctgagagttgcatactacatcgctggaagcactggagta

SEQ ID NO: 88809 - protein, 185 aa, Zea mays
  misc_feature: Ceres CLONE 1576249
  misc_feature: SWISSPROT Homolog: EC 2.7.11.1 Non-specific serine/threonine protein kinase
  misc_feature (156)..(156): Xaa is any aa, unknown, or other
MGCCGSSQRAGTHPEKKPPGALPPHRPSYSLNQHQAPPPPPPSAARAGARQVPPLKEFSLAELRAATAGFAAGNIVSESGEKAPNFVYRGRLEAGRRAIAVKKFTKMAWPDPKQFAEEAKGVGKLRHCRLANLIGYCCDGDERLLVAEFMPNDTLXKHLFHWENQTIDGAMASESCILHRWKHWS

SEQ ID NO: 88810 - DNA, 865 bp, Zea mays
  misc_feature: Ceres CLONE 1576251
  misc_feature: Encodes the peptide sequence at SEQ ID NO. 88811
  misc_feature (325)..(325): n is a, c, t, g, unknown, or other
  misc_feature (738)..(738): n is a, c, t, g, unknown, or other
  misc_feature (814)..(814): n is a, c, t, g, unknown, or other
  misc_feature (821)..(821): n is a, c, t, g, unknown, or other
ctggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccgngcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggccttcaccgtccgcaacatcgccctcatggntccaccctacgacaagatcaagtacgccggcacagggtcccgcatcgagtacgccgtgtgcgcgctcaaggtgcangtcatcntggtcattgggcacagctgctgcggtggcatcagggcgctcctc

SEQ ID NO: 88811 - protein, 161 aa, Zea mays
  misc_feature: Ceres CLONE 1576251
  misc_feature (79)..(161): Pfam Name: Pro_CA Pfam Description: Carbonic anhydrase
  misc_feature: SWISSPROT Homolog: EC 4.2.1.1 Carbonate dehydratase
  misc_feature (119)..(119): Xaa is any aa, unknown, or other
  misc_feature (144)..(144): Xaa is any aa, unknown, or other
  misc_feature (147)..(147): Xaa is any aa, unknown, or other
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIALMXPPYDKIKYAGTGSRIEYAVCALKVXVIXVIGHSCCGGIRALL

SEQ ID NO: 88812 - DNA, 1071 bp, Zea mays
  misc_feature: Ceres CLONE 1576252
  misc_feature: Encodes the peptide sequence at SEQ ID NO. 88813
  misc_feature (71)..(71): n is a, c, t, g, unknown, or other
  misc_feature (1071)..(1071): n is a, c, t, g, unknown, or other
tttttttttttttttttttcatgccgagcagagagtcaaatccaacgacggattaaaaaaaacaaaaaatntattaaaatggagctccccgcggtggcggccgctctagaactagtggatcccccgggctgcaggaattcgtctcacccctagaaaaagtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgccttcttggcaatggctgaagaatttgggtgtggttcattccggtatgttgggtgggggagaaccatgcttcatggttttggctccccaccttttggaaaaacattggggtacaagtgggaaggaaaactttgggttcccgggaataaaaggcaagtttaaaattctcctggtggcccgaaatttgggggccccaaaatttggaaggggaaaaccttggaccttttggtgcgaaaccggggggtttcccttttccccacggaaggttaaagagaaagggtttatccccacccttgggggaaaaaggggggttttatcacagccctctcccgggtaaaacggacccccctgtggtggggaccctttttttcccacccatatgggcccttttttccacaaaggtggctttctcggaaacaacatttgtgtgaaaaaaccacaaaattttgtggggggacccttttcctttgtgggcgccaccctcttatttttcagggggaagaaaaacaatggccccttatgggggcccaaaaagagaaagcgcgcccccttcttaaaatttttn

SEQ ID NO: 88813 - protein, 174 aa, Zea mays
  misc_feature: Ceres CLONE 1576252
MAMIDEPLYPIAVLIDELKNEDIQLRLNSIRRLSTIARALGEERTRKELIPFLSENNDDEDEVPSWQWLKNLGVVHSGMLGGGEPCFMVLAPHLLEKHWGTSGKENFGFPGIKGKFKILLVARNLGAPKFGRGKPWTFWCETGGFPFSPRKVKEKGFIPTLGGKRGVLSQPSPG

SEQ ID NO: 88814 - DNA, 823 bp, Zea mays
  misc_feature: Ceres CLONE 1576253
  misc_feature: Encodes the peptide sequence at SEQ ID NO. 88815
  misc_feature (446)..(446): n is a, c, t, g, unknown, or other
ggagctcaccgcggtggcggccgctctagaactagtggatcccccgggctgcaggaattcgtctcacccctagaaaaaggcctcgacccctctcgcgcactcgcgcttgcctgcacgctccagggcttcaggctcccctcccacctcgccgcggcagccatggcgatcacggcgccaactcccgacatccgcggcgagcgtcagtccggccaggacgtccgcacgcagaacgtgatggcgtgcggcgcgttgtccaacatcgtaaaatcctcgctcggccccgtcggtctcgacaagatgctagtggacgatatcggtgatgttacaatcactaatgatggtgcaaccatacttaagatgttggaagttgagcacccagctgccaaggttcttgttgagttggctgaactccaagaccctgaggtaggagatggaacaacttcccnttgtcacctaagcgggaggagctgctcaagagaaccaacgatcttgggaaaaaaaaagatcccacccacccccctataatcagggggcttccgggcttgccttttccgtgaaaaccctgccaaataatgtgggagggaaaaaaattgggccggtcaaagggtgggaaaaaacctgtgggaaaaaaagaaccgcgcccttgatacaaagctcctggggaaaaaaaaaacctaagccatggggtctttctcaaaagaggtgtgtatataaaaaaaaggggagaccaggtggggagtgttccttgttgtgcgaaacctctcggggggtggtggttttgagaaaaaaaacttgtggttctacaaagagctgcgttgtgaaa

SEQ ID NO: 88815 - protein, 121 aa, Zea mays
  misc_feature: Ceres CLONE 1576253
  misc_feature (96)..(96): Xaa is any aa, unknown, or other
MAITAPTPDIRGERQSGQDVRTQNVMACGALSNIVKSSLGPVGLDKMLVDDIGDVTITNDGATILKMLEVEHPAAKVLVELAELQDPEVGDGTTSXCHLSGRSCSREPTILGKKKIPPTPL

SEQ ID NO: 88816 - DNA, 894 bp, Zea mays
  misc_feature: Ceres CLONE 1576254
  misc_feature: Encodes the peptide sequence at SEQ ID NO. 88817
ggaactccccgcggtggcggccgctctagaactagtggatcccccgggctgcaggaattcgtctcacccctagaaaaagtactcccctagcctgcctcggtgcgccgccgccacacctccaccatggctgcgaccacgccggccaccgacccgccggatgccttgcttgcagtaacagctgatgctcccactcctgctcgtcccaccccggcggagctggtagcccgcgccgtcgcccccgtcaagcccgccttcctctgcccgcctcccgtccgtgaggcacccaaggaggagggtaaagccgccggcggcggggccgtcgtaaaggtggagaagaagtccaagcgccagctcaagcgcgagcggcagcaggaacaaaaatctacttctcacctttgcccccaagtagggaaaagtggaaatgtggactcatgcaaatatggtacttcttgtccgtttcagccctgacataaatgcctatttgtctcagaaaccacctgacccttgaagggccatgccccatttactggcctgggaaattttgtgtccatatggaacaaacttggccgattcccttattcacataaaggataacctttgctccctcaaaatcctcccgaagggaaaattgttgagaaaaatccctttgagcaaaagaaatttcaaaagctccttttgggaaaagcaaaattttaatttttcccaagggccgtggccccaaaacaaaactttcttggggccttaagggaggggaaaccaagaattaaaggccgaaggccggtgaaattggtgtgataatccccaggatgaaaaacatggtaaccctcaaaatggggtgaagggaacaaaaacacctttttttttctaaagagattccctggaaaaaatggtgta

SEQ ID NO: 88817 - protein, 114 aa, Zea mays
  misc_feature: Ceres CLONE 1576254
MAATTPATDPPDALLAVTADAPTPARPTPAELVARAVAPVKPAFLCPPPVREAPKEEGKAAGGGAVVKVEKKSKRQLKRERQQEQKSTSHLCPQVGKSGNVDSCKYGTSCPFQP

SEQ ID NO: 88818 - DNA, 916 bp, Zea mays
  misc_feature: Ceres CLONE 1576255
  misc_feature: Encodes the peptide sequence at SEQ ID NO. 88819
tacccgcggtggcggccgctctagaactagtggatcccccgggctgcaggaattcgtctcacccctagaaaaaagctacctgcctcccttcttgcacccaccgctgccgtcctgcccagatcccgctcgccggtggtgctcccctccccccgcgccgctggcgccgccggagcgagggggactgcccaaaccctagtgggagttggagactaggaggaagggcgcgagatccggcggcggccaccccgatgggggacttcaacgtcgcgctggtgatcgtggcggcggtggtcagcgtgctggtgctgctcgtcagcgtctacctgctcgtcaactaccagcaccccgacgacgtcaaccaggcctacttccccaagctcgtcgtcgtgctcggccccaccgtcgccgtcctctcaatcctcatgctccctgccgacgtcgccaatcgccaggcctgccgcaaggccgtctacaacggcgcctgcagtctcacgctcccccatgaggacgctctggctcgtcgtctacatcgtaagacgcccgtcctcgttcttcctcgtcatcccctttcgcatggttctactccgaggggcgaacagggacaagttccgtccgggaaaaggcttaagggattgcgcttcattctggggtcgccgcgctccaccggggggtgtgacggccttcgttcctccggcatttttatacggaccttgtttggtaaaatggggactttcctggggggggaaccttttttttcactggtcccgaacttttctccaaatctcatttttcctggatttcccaagagggccaaccccttgcttttagtcccattggactccccccagtgggcggggtttttctttgtgcacgcggctataatttccgaaaaaaattttgaaaaatggctttgtca

SEQ ID NO: 88819 - protein, 222 aa, Zea mays
  misc_feature: Ceres CLONE 1576255
MGDFNVALVIVAAVVSVLVLLVSVYLLVNYQHPDDVNQAYFPKLVVVLGPTVAVLSILMLPADVANRQACRKAVYNGACSLTLPHEDALARRLHRKTPVLVLPRHPLSHGSTPRGEQGQVPSGKRLKGLRFILGSPRSTGGCDGLRSSGIFIRTLFGKMGTFLGGEPFFSLVPNFSPNLIFPGFPKRANPLLLVPLDSPQWAGFFFVHAAIISEKNFEKWLC

SEQ ID NO: 88820 - DNA, 1044 bp, Zea mays
  misc_feature: Ceres CLONE 1576256
  misc_feature (662)..(662): n is a, c, t, g, unknown, or other
  misc_feature (665)..(665): n is a, c, t, g, unknown, or other
  misc_feature (1023)..(1023): n is a, c, t, g, unknown, or other
  misc_feature (1024)..(1024): n is a, c, t, g, unknown, or other
ccccgcggtggcggccgctctagaactagtggatcccccgggctgcaggaattcgtctcacccctagaaaaagtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgctgccccgccgcgcgccggagtgcccatcgccctccgcctccacgcgcgccaagccgagcccccctcccgcccccaccgacgactggttggacaacccggatctggggaccttcctcctgaagcaggcaccccacaccatggtgtcgggcgaggagggcggcccatcggaaacgaccatagcctcaaatcccggcgagcgagccacctcgaatgacccgtgttagggacgatggtctgatagtccgcggcgatccccgtgataagccgacttctccctaggaaccagtgacagcgattacccctacagtttgaatataaaaaaaccaaccggtgcttgctcctgtgggccaaatcgatgaggtaatctaccactggcgcagaaagtctggtagcgacccntcntagtaaggagcttcttgagaacccccggtttggcaaattgaagcatgtgtctgcagttgggatttaggagaagacagaatgtcacctttttatggataaagagggtgggccccttatccgggttgcctaaatgtagggccgcggttggcgcagtcagtgagtgtcaaaaagcattgacgcgggggaaccgctatatgacagctattgttccttataaaaataaaccgtattcacgtctgtttaatctctttatttcggccgccgcctagccattctctgtactatgttagtgttcacaacaagtatcgcccctctcactcgtcactgctcctgttagtgcagatccaattcgcctttnncccccactcccgctatttct

SEQ ID NO: 88821 - DNA, 856 bp, Zea mays
  misc_feature: Ceres CLONE 1576261
  misc_feature: Encodes the peptide sequence at SEQ ID NO. 88822
  misc_feature (609)..(609): n is a, c, t, g, unknown, or other
  misc_feature (656)..(656): n is a, c, t, g, unknown, or other
  misc_feature (711)..(711): n is a, c, t, g, unknown, or other
  misc_feature (791)..(791): n is a, c, t, g, unknown, or other
  misc_feature (794)..(794): n is a, c, t, g, unknown, or other
ctggagctccccgcggtggcggccgctctagaactagtggatcccccgggctgcaggaattcgtctcacccctagaaaaagcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcggccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgatcggctgccggccgacagggccgccttcgcgcgctccctcgcggcgtcgctctcctactggaaangtcccgtggggaagaaagggggtggtggttgaaattacccggtggantctagccgagttcgtccctttagcagtgaaggaaggcttcaagtaccaccacgcnggaggaagcgtatttgatgatgacgtactggatccccgatgaaccgaatatgctcccagcaaatgcttctctcagtgggnttngggggggggtttttttgggaccaacgaccaaagggagggttcttagtggtgcaagagaagta

SEQ ID NO: 88822 - protein, 152 aa, Zea mays
  misc_feature: Ceres CLONE 1576261
  misc_feature (143)..(143): Xaa is any aa, unknown, or other
MESGLLDTAAAAGLCPVAAGRRRVGSTGTARCFLSCSCASRDCRVSASYSHSISRMLSGVRSAARKRLFRSDPAELLGVANWSETGGGGAGGHQHWWTALENNFVLEATDDEYGGVVVDADRLPADRAAFARSLAASLSYWKXPVGKKGGGG

SEQ ID NO: 88823 - DNA, 963 bp, Zea mays
  misc_feature: Ceres CLONE 1576262
  misc_feature: Encodes the peptide sequence at SEQ ID NO. 88824
  misc_feature (840)..(840): n is a, c, t, g, unknown, or other
  misc_feature (884)..(884): n is a, c, t, g, unknown, or other
  misc_feature (903)..(903): n is a, c, t, g, unknown, or other
  misc_feature (915)..(915): n is a, c, t, g, unknown, or other
  misc_feature (951)..(951): n is a, c, t, g, unknown, or other
aaagctggagctccccgcggtggcggccgctctagaactagtggatcccccgggctgcaggaattcgtctcacccctagaaaaagaggcgataggcatcgtcgtcccacccagcagtgcagagactctctctctctctccccggccacctctcgctcacgagcaccccatcttcccggccagggcctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctcctcctggcgctccgctcgctcaccttccagctctggttctcctacggcaacatgctcttcttcacccgccgccgccgcgtcgtcaaggacggcgtcgacttccgccagatcgacgccgagtgggactgggataacatggtgatcctgcaaaccctggtcgcggcggtggcgatgggcagcgcggcgttcccggccgtgtcggagctgcgggcgtgggacccgcgcgggtgggccctggccttgctcctgcacgtggccgtctcggagcccgtcttctactggacccacagggcgctgcaccggggcccgctcttcagccagtaccacgccaggcaccactcgtcccccgtcacgcagccgttcacggccgggttcggcacgccgctggaagcgctgctcctgacgctggcgatgggggccccgctggcgggagccttccctggcgggcgcccgggtccgtgagcctggtctacggccacgtcctcctcttcgactgcctccnggtgcatggggtacaagcacgtggaagtcatctcgcacagggcnttcgccgccttccccgcgntcagatactcgncttaaccgcccacgtatttgagctgccccccagggnagaagacggcac

SEQ ID NO: 88824 - protein, 202 aa, Zea mays
  misc_feature: Ceres CLONE 1576262
  misc_feature (130)..(201): Pfam Name: FA_hydroxylase Pfam Description: Fatty acid hydroxylase
MGAPLASWPWASLGSYKYLLYGPLVAKVAHAWRETGSLPLGSWCLHLLLLLALRSLTFQLWFSYGNMLFFTRRRRVVKDGVDFRQIDAEWDWDNMVILQTLVAAVAMGSAAFPAVSELRAWDPRGWALALLLHVAVSEPVFYWTHRALHRGPLFSQYHARHHSSPVTQPFTAGFGTPLEALLLTLAMGAPLAGAFPGGRPGP

SEQ ID NO: 88825 - DNA, 820 bp, Zea mays
  misc_feature: Ceres CLONE 1576264
  misc_feature: Encodes the peptide sequence at SEQ ID NO. 88826
ctggagctccccgcggtggcggccgctctagaactagtggatcccccgggctgcaggaattcgtctcacccctagaaaaagtgcaggcaggcaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagttctctttcgaacgcaaggctgcaattgagtacactcattctttatcaagggcacagcctgctcgttctctcaatggtgctggcctttgtcctgctagtagatcacttagcacccaggccgccactacgtcaagcacaccacagcctccgcctcccccaccccctccagagaagactcactttggtggcctcaaagatgaggatcgcattttcaccaacctctatggtctgcatgaccctttcctgaaaggcgcgatgaagagaggtgactggtataggaccaaggatttggtgatcaagggggcagactggatagttaatgaaatgaagaaatcaggtctttcggggtcgtggagggggcaggttttccttccggtctcaaatgggccctttatggcccaaggttccagattggacgccccttcttaatcttggccgttaagccgaaagaaaaagggaaccctgggaacttggaaaaaaaagaagaaaatcttggcggccatggaccccccaacaaagctttcggggaagggaggcccctttattgggcggga

SEQ ID NO: 88826 - protein, 154 aa, Zea mays
  misc_feature: Ceres CLONE 1576264
  misc_feature: SWISSPROT Homolog: EC 1.6.99.5 NADH dehydrogenase (quinone)
MALRRALLRSAEFSFERKAAIEYTHSLSRAQPARSLNGAGLCPASRSLSTQAATTSSTPQPPPPPPPPEKTHFGGLKDEDRIFTNLYGLHDPFLKGAMKRGDWYRTKDLVIKGADWIVNEMKKSGLSGSWRGQVFLPVSNGPFMAQGSRLDAPS

SEQ ID NO: 88827 - DNA, 885 bp, Zea mays
  misc_feature: Ceres CLONE 1576266
  misc_feature: Translation starting site: 215
  misc_feature (770)..(770): n is a, c, t, g, unknown, or other
  misc_feature (855)..(855): n is a, c, t, g, unknown, or other
ctggagctccccgcggtggcggccgctctagaactagtggatcccccgggctgcaggaattcgtctcacccctagaaaaaacccttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtgggttgagagtggtgctgtgcccatctttgttaagctcctcaactccaatagcgaggatgttcgtgaacaggcatgcactgaattacaatangtacactcttctatatgagaattaatgtagagtgggtggctaggtcctttttttttttgggttttgcaggctgtatgggcttaangtaatgttgctggtgactccccaaagtgcc

SEQ ID NO: 88828 - DNA, 919 bp, Zea mays
  misc_feature: Ceres CLONE 1576267
  misc_feature: Translation starting site: 379
  misc_feature (862)..(862): n is a, c, t, g, unknown, or other
  misc_feature (869)..(869): n is a, c, t, g, unknown, or other
ggagctccccgcggtggcggccgctctagaactagtggatcccccgggctgcaggaattcgtctcacccctagaaaaaagggcaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatggggggagggtgatctcgtggacccaccgccagacagcttcccggacgccgtggaggacgacagcgatgacgacgttgaggacatcgaggagctggagcgccgcatgtggcgcgaccgcatgaagctgaagcggctcatgtagctgcagcagagccgcggcaaagatcccatggctagcggtgggggcctggccgaacgctcatccaagccaatgcagtcgcaagagcatgcccggcgcaagaagatgtcgcgcgcgcaggacggcatcctcaagtacatgctcaagaatgatggaagtgtgccgcgcgccaggggttttgtgtaccggatcattccnggataanggccaggcggggaacggggccctcgaataaactcggtgcctgggtggagg

SEQ ID NO: 88829 - DNA, 788 bp, Zea mays
  misc_feature: Ceres CLONE 1576268
  misc_feature: Encodes the peptide sequence at SEQ ID NO. 88830
  misc_feature (692)..(692): n is a, c, t, g, unknown, or other
ctccccgcggtggcggccgctctagaactagtggatcccccgggctgcaggaattcgtctcacccctagaaaaactggaagcatcatctgttcagcaacagtggccctctggacgtgttcagggatttctctcagataaaataaatatgtcgacagatcaatctgcccatagatcagattctatcccgccttcatctaagaaaaaagcactgaccttctcatccagtttctcacgaagagctcagactccacattctgtttctggcagcagaacaagcaacatccttaaaagtcctgtacctattgcggctgatactagagatgcagaaatgttgaataagacaccactgtcgctgccacttaagaggaagcttgtggatgtgaaggataataattctgtatcagcaacgaagcgcctcgcaacaactgatcaaacgtaccaaccctctgtattccaaactcctgctcctactcgcaaaggtctgtcagtagcagtagattctcctacttcatttcattgtggccggacaaacttcaactatgtttctactgaaaacttggacaattctcaaagcacaccaggaacgttgatcaccacaacacttcctgggtgtgaatgatcaacaatcaggaaatttggaacgtatgacacttgactcactggttgtacaatacttgaaacatcaacaccngccagtgtcctgctccagttacaactgttgcacccactttctcttttgcaccctcatgtttgccctgagcctagtcgcagccttagtgcacctgca

SEQ ID NO: 88830 - protein, 205 aa, Zea mays
  misc_feature: Ceres CLONE 1576268
PRGGGRSRTSGSPGLQEFVSPLEKLEASSVQQQWPSGRVQGFLSDKINMSTDQSAHRSDSIPPSSKKKALTFSSSFSRRAQTPHSVSGSRTSNILKSPVPIAADTRDAEMLNKTPLSLPLKRKLVDVKDNNSVSATKRLATTDQTYQPSVFQTPAPTRKGLSVAVDSPTSFHCGRTNFNYVSTENLDNSQSTPGTLITTTLPGCE

SEQ ID NO: 88831 - DNA, 867 bp, Zea mays
  misc_feature: Ceres CLONE 1576271
  misc_feature: Encodes the peptide sequence at SEQ ID NO. 88832
  misc_feature (593)..(593): n is a, c, t, g, unknown, or other
  misc_feature (829)..(829): n is a, c, t, g, unknown, or other
ggagctccccgcggtggcggccgctctagaactagtggatcccccgggctgcaggaattcgtctcacccctagaaaaaaccccaacaccccatctcatctcttgctcctcgggcgtacttgcagttgcagtgtcctcggccgcctctagtcctagacgtttacttcttcctttcaccgcatcaagcacagagcaagctaggcaagagccatgggcgcctttctgctctatcgactgtcacctgacgccggacgtcaagctcacctgcaccgtccacgccaagaagaggcgggcgtcctccgcggcggcgaggggcaaggtcctgccgctgccccccaggacaatcgggtgaacaaacgtcggcaagactttccagctctacgcgtccaagaaccccaacgtgttctttcgcccagaagcagaaacggtacagggcaatcttcaagacggcacatgctgggctgcccctgcatgatggtgtccagctcggaggcagcacgcttcttgctacgcagctatgcccacctcttcaagcccaccttcacgacgagctaagagcgcatgctgtggcccgcatgccatcttcttccacanggggagaacaacgaccacttccgctcgctgctctcccgggctttctcacccgaggccatgcgcggctcagaacccgacatcgaggccatagagctgcgctcgctccagtcctgggacgctcgtctactcaacaacttacaatatatcgacctgagcgcgctcaaagtggcattgctgtccatcttctgccgaagaataaatgccgaacggtgcataagctgaatcattgctactgnacccctggagaaagggaactactcgaatcccccggaac

SEQ ID NO: 88832 - protein, 84 aa, Zea mays
  misc_feature: Ceres CLONE 1576271
  misc_feature: SWISSPROT Homolog: EC 1.14.13.93 (+)-abscisic acid 8'-hydroxylase
  misc_feature (11)..(11): Xaa is any aa, unknown, or other
MLWPACHLLPXGENNDHFRSLLSRAFSPEAMRGSEPDIEAIELRSLQSWDARLLNNLQYIDLSALKVALLSIFCRRINAERCIS

SEQ ID NO: 88833 - DNA, 775 bp, Zea mays
  misc_feature: Ceres CLONE 1576276
  misc_feature: Encodes the peptide sequence at SEQ ID NO. 88834
  misc_feature (293)..(293): n is a, c, t, g, unknown, or other
  misc_feature (294)..(294): n is a, c, t, g, unknown, or other
ggagctccccgcggtggcggccgctctagaactagtggatcccccgggctgcaggaattcgtctcacccctagaaaaaaccccaaactccaaatccaatccaagcaagtcctccccatgctcctcccgctcctcctcctcgccgccttcctccatggcttggcggaggcgcagggcggcctcccgtcgctgccgatcggggtgaactacggcgcgaacgcagacaacctaccctcgcccgccgccgtggcggcgttcctggccaagagcacgaccatcgaccccgcgtgaagnnctgttcgacgcgaaaccccgggcctttcctccgacgccgtttcgcccggcaaaagggggccccttccatttggccctttgggccggtttttccaattcccccaaaattcccggcctttcccgggttctttttggcgccaaaaaaaatccccccgggggcccttggaaaaacccccccccccccccggggggggggggtttcccccaaaaaaaaaaaccttgttttccccccccccccaacagttgttttttcccccgggggggggggccccaaaaaaaaaaaaaaaccccccccccttttccttttatattagtggggggggggggggaaaaaaaaaaaaaaaaaaaggtggttttttttggtggggggcccccccccccccccccccgggcggggggtgggggggggggcccccacaaaaaaaaaactaaatttttcctttttgggggggggggggcgggccccccccccctcccctccc

SEQ ID NO: 88834 - protein, 57 aa, Zea mays
  misc_feature: Ceres CLONE 1576276
  misc_feature: SWISSPROT Homolog: EC 3.2.1.39 Glucan endo-1,3-beta-D-glucosidase
MLLPLLLLAAFLHGLAEAQGGLPSLPIGVNYGANADNLPSPAAVAAFLAKSTTIDPA

SEQ ID NO: 88835 - DNA, 2026 bp, Zea mays
  misc_feature: Ceres CLONE 1576280
  misc_feature: Encodes the peptide sequence at SEQ ID NO. 88836
aggacaggcctcactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccacttcctccctatccatcgtgaagcccctgctttcgttgagcaggccactgagcagcaaattcttgttactggaatcaaggtcgtggatcttcttgcaccctaccaaagaggtggaaaaattggtctattcggtggtgcaggagtgggtaaaactgtgctcattatggagctaatcaacaatgttgctaaggcccatggtggtttctctgtgtttgctggtgttggagaacgtacccgtgaagggaatgacctgtacagagaaatgattgaaagtggtgtcattaagctaggtgacaagcagagtgaaagcaagtgtgctcttgtctacgggcagatgaatgagcccccgggtgctcgtgctcgtgttgggttgactggtttgactgttgctgaacatttccgtgatgctgaaggacaagatgtgcttctgtttattgacaacattttccgtttcacccaggcaaattctgaggtgtctgctcttcttggacgtatcccatctgctgtgggataccagccaacccttgccactgatcttggaggactgcaagagcgtattacgacaacaaagaagggttctattacgtctgtccaggctatatatgtgcctgctgatgacttgacagatcctgctcctgctactacctttgcccatcttgatgctacaactgtgttgtcacggcagatctctgagcttggtatttatcctgctgtcgatccactggattccacatcaagaatgctttctccccacgtgctgggtgaggatcattacaatactgctcgtggtgttcagaaggttcttcagaactacaaaaatcttcaggatattattgctatcttgggtatggatgagctcagtgaggatgacaagttgacggtcgctcgtgcaagaaagattcagcgtttcctgagccagcctttccatgtcgctgaagttttcacaggtgctccagggaagtatgtggagctgaaggaaagtgtgaagagtttccagggtgttttggatggcaagtatgatgacctccctgagcagtcattctacatggttggaggcattgaggaagtcattgctaaggccgagaaaatcgccaaggagtctgcttcataaggaggcttcttgcttgttgaatcctgtacaatcaagttccatttttggattttaagcgattgtttatgcttttcacagttaggcagcacgagttggagatccatctcctgctgagatgcttgtttttctctttgttgttcaaacacttcacacccaaataagcaactgcagtgacattaattttggctgcaccaaagttacatgaactgaagaaacttgtggcctgtgtgacccggatccatcagaacaaaaaaaaaaaaaaaaa

SEQ ID NO: 88836 - protein, 553 aa, Zea mays
  misc_feature: Ceres CLONE 1576280
  misc_feature (207)..(429): Pfam Name: ATP-synt_ab Pfam Description: ATP synthase alpha/beta family, nucleotide-binding domain
  misc_feature (442)..(549): Pfam Name: ATP-synt_ab_C Pfam Description: ATP synthase alpha/beta chain, C terminal domain
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 88837 - DNA, 958 bp, Zea mays
  misc_feature: Ceres CLONE 1576282
  misc_feature: Encodes the peptide sequence at SEQ ID NO. 88838
tggagctccccgcggtggcggccgctctagaactagtggatcccccgggctgcaggaattcgtctcacccctagaaaaaatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcaaccgtgccaagagtaaccaggacccctcttttttccaagaaccagtacaaaccgcctcttcggcctcttaggagtagttcagtagtaaggcgatcgttgcagcaggagcaagaggagagggtgggcccggcgtcctctgtctctgtggcctccggcgagcgacaggaggaggcgaccgcctcgcatcatgttggaggggtggatgaggccaaggcgtcgggccatgttggagaggcagataaaggaggccaaggagaaggcgacggcgaggagaagaggagcacagacgagcagcaggaggtggactggaagtcagacgaggagttcaagaagttcatgggcaatccctccatcgaggccgccatcaagttggagaagaagcgcgccgacaggaagctccgcgagctggaccgcgaagccgacgcaacccccgtcgccggcctgttccggggcttggtgaaggaccagcttggcccgctagaaacatatgctggagctcgcggaaacaaaacctcaaagccactcgacctcaacaagctggagaacctgttccgggtacaacactttcttcccccttggacctccgggaggtttcggcaaccgcgggatcttcattgggaacccgccgtaagcccatccgaggaggtggcgccctaactgggaaaagaaaaatctcccaaggccgcgggaaaaaaagggtcaacccctggtgttctgggaaggagaaaaaacaccaa

SEQ ID NO: 88838 - protein, 240 aa, Zea mays
  misc_feature: Ceres CLONE 1576282
MSSASLASSLLCSSSASTSRSATVPRVTRTPLFSKNQYKPPLRPLRSSSVVRRSLQQEQEERVGPASSVSVASGERQEEATASHHVGGVDEAKASGHVGEADKGGQGEGDGEEKRSTDEQQEVDWKSDEEFKKFMGNPSIEAAIKLEKKRADRKLRELDREADATPVAGLFRGLVKDQLGPLETYAGARGNKTSKPLDLNKLENLFRVQHFLPPWTSGRFRQPRDLHWEPAVSPSEEVAP

SEQ ID NO: 88839 - DNA, 957 bp, Zea mays
  misc_feature: Ceres CLONE 1576284
  misc_feature: Encodes the peptide sequence at SEQ ID NO. 88840
tcaccgcggtggcggccgctctagaactagtggatcccccgggctgcaggaattcgtctcacccctagaaaaattctgagagctccaagacagagactacagggtaaagaagaacggaagggtcatacattaataagagcctcttaactcttggaacagtcattggcaagctcaatgaacggagggcaacacatataccctatcgtgattctaagttgactcgtctactactgtcatcattgagtggccatggtcaagtctcactaatttgaacaattacgccaacgtcaagtgacatggaagaaacacatcattccttgaatgttgccagctcatcaaaacctgtccaaaatttatggctcccccccacccgggtggtttacgagaaatttttggccccccccaacatcacaaaaaaaaatccccctttaaagcaaaaaacccgattagcctaaggtgaaggaaatgattggttgggggcccgcccgggaacaaaatatttgggggtttttctctcaccaattttggaggggggggttcacaggtcaaaaaaagggaaagtcttccccccctggggtagacggaaaaataatataagggtccaaaaacccctctttttttttaaattgaggaaaaggggaaataaccccaccgtttttttgagatacacaacggtatgaaaaaacaccatgtgttttttcccccccccacaaaaaaaaacaatatattaccctcctcccccctgtttttgaaagaaattaggtggataacttctctaaaagagcacgtcctgatttttcttctctttttctttggggtgcgacataaaagaagagtttatacccccctcttttctcccaaagaaaaaaatttttatttatagaatttttttctcctcaagagaggtggggggcgccccctcttagaggggaagggctctccctctttaataccctg

SEQ ID NO: 88840 - protein, 52 aa, Zea mays
  misc_feature: Ceres CLONE 1576284
MEETHHSLNVASSSKPVQNLWLPPTRVVYEKFLAPPNITKKNPPLKQKTRLA

SEQ ID NO: 88841 - DNA, 874 bp, Zea mays
  misc_feature: Ceres CLONE 1576285
  misc_feature: Encodes the peptide sequence at SEQ ID NO. 88842
  misc_feature (487)..(487): n is a, c, t, g, unknown, or other
  misc_feature (562)..(562): n is a, c, t, g, unknown, or other
  misc_feature (623)..(623): n is a, c, t, g, unknown, or other
  misc_feature (629)..(629): n is a, c, t, g, unknown, or other
ctccccgcggtggcggccgctctagaactagtggatcccccgggctgcaggaattcgtctcacccctagaaaaaattcactagaacactctcaccggccaccacctccacctcgtcctctcccaccaccgccatcgcgcaagccctatcccgatctagccggcggcaggcactaaatcccgccgcttgcggcatcccgggacgcgcctcgccgaattcgccgctcctcgcactgcaacacgcccggaccactaaaaaagaggcaactctggggcataacgtacttcaccttgattacaggttactgcatgccatgtagtattttattattggtggaggttgtcaccacaagacatatgttgtgatttctccatggcgaggagatgaaacaggtgtgggggcggagcagcaaggacatgacaaccatgccccctccgcgccaccgtggcgctgctaagaagcccatgtggatcatagtgctattgtcnttggtttgtgttgcccttatgggggcctatgtctacccaccacggcactactctgcatgctacttttcttgctcnagtgtctgtaccccgttcaaggattggctacctgctgttgttcgggagcaaactgatgaanaaatantgtcatcccctggttaataggaaatcttcttttcaattccctatggcctgtggtccaaagaaccccaaagaatgccctttatagttcttgaaaaccaaggttccattgccttttttaaaaaattgtggggaaggaaaattttaacggggcccatggatggggccgaatattcccacccttaatcccaaggcatctcccggggaaaataccccgggaaaatttgtcaaacttcccctcgtttgggg

SEQ ID NO: 88842 - protein, 87 aa, Zea mays
  misc_feature: Ceres CLONE 1576285
  misc_feature: SWISSPROT Homolog: EC 3.1.1.4 Phospholipase A(2)
  misc_feature (81)..(81): Xaa is any aa, unknown, or other
  misc_feature (83)..(83): Xaa is any aa, unknown, or other
MKQVWGRSSKDMTTMPPPRHRGAAKKPMWIIVLLSLVCVALMGAYVYPPRHYSACYFSCSSVCTPFKDWLPAVVREQTDEXIXSSPG

SEQ ID NO: 88843 - DNA, 963 bp, Zea mays
  misc_feature: Ceres CLONE 1576287
  misc_feature: Encodes the peptide sequence at SEQ ID NO. 88844
  misc_feature (600)..(600): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (666)..(666): n is a, c, t, g, unknown, or other
  misc_feature (667)..(667): n is a, c, t, g, unknown, or other
  misc_feature (671)..(671): n is a, c, t, g, unknown, or other
  misc_feature (672)..(672): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (690)..(690): n is a, c, t, g, unknown, or other
  misc_feature (691)..(691): n is a, c, t, g, unknown, or other
  misc_feature (710)..(710): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
tggagctccccgcggtggcggccgctctagaactagtggatcccccgggctgcaggaattcgtctcacccctagaaaaaaagacacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaacaaggataagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgcctatataatccnaaaagaaaaagaaataccgtccggggatggtttgtttgccaaannnnnnnnnnnnnnnanaaaaannaaannaannnanaaaaccccccnnaaacaaaaaaacaaaaaanccnnnnttatttttttgaaaaggaagaaacttggaaaaccaaaggcctaggacccgccctttaataaaggggggacccggcccggggaaaaaataaggggccctccggtttaagggggggcaaaacccaaatttttttcgggagacctgaggccaatttgttttccaaaataaaggggctaaaataccccccacgaaaatacccacagggggttttaaaacaattagagggccatagggtgggggagaaaaag

SEQ ID NO: 88844 - protein, 103 aa, Zea mays
  misc_feature: Ceres CLONE 1576287
  misc_feature (2)..(103): Pfam Name: Dehydrin Pfam Description: Dehydrin
MSGIIHKIEEKLHMGGDHKNKEEEHHKKAEEHHKKEEGEHHKKDGGEHKEGIVEKIKDKITGEHGDKSGDHKEKKDKKNKDKKKHGEGHDHDGGHSSSSSDSD

SEQ ID NO: 88845 - DNA, 828 bp, Zea mays
  misc_feature: Ceres CLONE 1576288
  misc_feature: Encodes the peptide sequence at SEQ ID NO. 88846
ctccccgcggtggcggccgctctagaactagtggatcccccgggctgcaggaattcgtctcacccctagaaaaaacagcttaaactgtaaaaatcgaggggttcaaacagaaaagtgagccccaaaccctacaccctcatggaagcgtggccacctctcgcccccgcggcggccactccggcctgtgccttggcgtggggagcagcagcaacggcgcagcggaaggccgtggagcaggagtcagcggcgcaggcggtgagccgcatcgtggcgagctgcgccaactccagcggcgtggcagtcgccgtggtggacgccaacgccgtcatctccggcggctccgctctctccacttccgcggggcgccttgtcaccgtgcccgaggtgctcgaggaggtccgggacgcaaccgcgcggcggcgcctcgggctcctccccgttcccgttgagaccgttgaacctgcgccggagttcgttaagaaagttaccaagtttgccagggagacaggagacatccaaacgctttcagatgttgatataaagattattgctttggcttacatgttagaagctgagatccatgggactagccatttgcgagagcaccctcctcctctgcatgaagtgaatgtcagaaagctgtcagaagctcaaatgcctggttgggggctctaatgtgcctaacctgaaagagtgggaagagttgggatcagatgtcctgaagctgggtggagatatcaaattctcgaaatactccctctgaaaggatattgagaggtcagataatcctgaatgcgtgataccaacagtctctgtggggcaacaaga

SEQ ID NO: 88846 - protein, 178 aa, Zea mays
  misc_feature: Ceres CLONE 1576288
MEAWPPLAPAAATPACALAWGAAATAQRKAVEQESAAQAVSRIVASCANSSGVAVAVVDANAVISGGSALSTSAGRLVTVPEVLEEVRDATARRRLGLLPVPVETVEPAPEFVKKVTKFARETGDIQTLSDVDIKIIALAYMLEAEIHGTSHLREHPPPLHEVNVRKLSEAQMPGWGL

SEQ ID NO: 88847 - DNA, 783 bp, Zea mays
  misc_feature: Ceres CLONE 1576294
  misc_feature: Encodes the peptide sequence at SEQ ID NO. 88848
ggagctccccgcggtggcggccgctctagaactagtggatcccccgggctgcaagaattcgtctcacccctagaaaaataccaagtattacattgaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcagcgacaaggccatcgcggacgggagcctcctggacctcctgcgccaggttttcacgttcgggctctccctggtgaagctggacatccggcaggagtcggagcggcacaccgacgtgatcgacgccatcaccacgcacctcggcatcgggtcgtaccgcaagtggcccgaggacaagaggcaggagtggctgctgtcagagctgcaaggcaagcgcccgctgctccccccggaccttccccagaccgacgagatcgccgacgtcatcggcgcgttccacgtcctcgaggagctcccgcccgacagcttcggcccctacatcatctccatggcgacggccccctcggacgtgctcgccgtgaagctcctgcagcgcgagtgcggcgtgcgacagccgctacccgtggtgccgctgttcgagaggctggccgacctgcagtcagcgccccgcgtccggtgagcgccttccttctcgtgggactggtacat

SEQ ID NO: 88848 - protein, 43 aa, Zea mays
  misc_feature: Ceres CLONE 1576294
  misc_feature: SWISSPROT Homolog: EC 4.1.1.31 Phosphoenolpyruvate carboxylase
MATAPSDVLAVKLLQRECGVRQPLPVVPLFERLADLQSAPRVR

SEQ ID NO: 88849 - DNA, 849 bp, Zea mays
  misc_feature: Ceres CLONE 1576300
  misc_feature: Translation starting site: 326
ctggagctccccgcggtggcggccgctctagaactagtggatcccccgggctgcaggaattcgtctcacccctagaaaaatccacttcgcccgcccgcccgctgcctgactgccattattgcctcccggtcttcgctgtccatccgaccgtccgtggcttctccctccggtccccgctacccgccccgccccgccgagaagcttcgggctagctagcaagctagctagccacctacccgtgctttggttcggttggttggcgccataaccattgccgaggagcgagggagcagcccggcgggcagtcacgacgcggtgagtaagcatgctgggagcgagccccaggggcaggaaggccgccgcgccgccggtgaagctggggtcggcgaaggaggcaccggcggccggtggagctggaggagggagcggcggcaatgtgctggccgaagatgtgtgggaggtgcggcccggcgggatgctggtgcagaacaggggcggcggcgacgaccatccatcgtccaacgtgaagcccgtgcccaccatcgcggtcaaggtcaagcactgcggcgtcacggacgagatctacatcagttccgacgcctccttcggggagcatgagagctggtgggcgccaagatggggctgctccccgacgaacataaagtgctgtacagggacagggagcgtgactccaaggctgttctggaacggggccgcgtcaaggaccgcctccaagtgggtggtgctggggggacccccaaggcctgggctctacggcttcattggggagggccgcagaggggcacctttcgaaaggcccgccgggccattagcccaggaaccggccaa

SEQ ID NO: 88850 - DNA, 818 bp, Zea mays
  misc_feature: Ceres CLONE 1576302
  misc_feature: Translation starting site: 155
  misc_feature (781)..(781): n is a, c, t, g, unknown, or other
ctccccgcggtggcggccgctctagaactagtggatcccccgggctgcaggaattcgtctcacccctagaaaaaaaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgacaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcggggcacatcaacccggcggtgaccttcgggctgttcctggcgaggaagttgtccctccacaggggcggtgtttttaatcatcatgcagtgcctggggcgccatctgcaggcgcgggcctccttcaaaggggttccaccagggggctgtaccatgggaaaacggcggggggccccaaacattcgtgggcccccggccttaccccaagggtgctaccggcctagggggccggagaatttgtcggggaccctttaaatcctccaacataaaaccgttttttttcggccaaccnaaagggcataaaaagaaaacccccaggggaccccccc

SEQ ID NO: 88851 - DNA, 872 bp, Zea mays
  misc_feature: Ceres CLONE 1576303
  misc_feature: Encodes the peptide sequence at SEQ ID NO. 88852
tcaccgcggtggcggccgctctagaactagtggatcccccgggctgcaggaattcgtctcacccctagaaaaaagtccagcactccacctgtccaccccctcccccgctgctccaaaaggcgggcaccaaagaacaacccgagccccgagcacgagcgcccaatcaaatggcgccgcacaccaccgctggaggcgggggcggagccgaggatgaggtgtccgaggcggcggctgcatcccccgccctgcggcaccgccactcgggcaagggcgagagggctgggcggcaatggcggcgctggggccgaccgccagccgtccgcggagcgagtgttcgcggacaacgcggtgccatcgtggcaggagcagctcacgctgcgggcattcgtcgacagagcgctgcaggccgtactgttcagcgtcatactcatgaagctccacctcaccacacggatgatcccctccctcactgtctccgcggggctgctcggcttcttcttcgtccgcatgtggaccgccaccagccgagaagaagggctttcctccgccagcccttcaccaggccaggagcacacccgtcatccagaacctgcggttggtcactacctaccgggatcggccttcaggggggggctttgggcagttatccaggacggaaagaaggaccgaaacagcttaaacaaagccacagaaggcctaaggagggctaataaccataaaaagaatccctcaccgtggggatggatggaaccggggttccaaaaaaccctggcgaggttttattgggccctccctggcccccgtggcgccccttgaaaaagaataatgagagtggggaaattctcagtttaaacctaacccccagcggggga

SEQ ID NO: 88852 - protein, 201 aa, Zea mays
  misc_feature: Ceres CLONE 1576303
MRCPRRRLHPPPCGTATRARARGLGGNGGAGADRQPSAERVFADNAVPSWQEQLTLRAFVDRALQAVLFSVILMKLHLTTRMIPSLTVSAGLLGFFFVRMWTATSREEGLSSASPSPGQEHTRHPEPAVGHYLPGSAFRGGLWAVIQDGKKDRNSLNKATEGLRRANNHKKNPSPWGWMEPGFQKTLARFYWALPGPRGAP

SEQ ID NO: 88853 - DNA, 1306 bp, Zea mays
  misc_feature: Ceres CLONE 1576307
  misc_feature: Encodes the peptide sequence at SEQ ID NO. 88854
  misc_feature (20)..(20): n is a, c, t, g, unknown, or other
  misc_feature (914)..(914): n is a, c, t, g, unknown, or other
  misc_feature (1081)..(1081): n is a, c, t, g, unknown, or other
aaagaaggaaatttttttancggggttgtttttttacttctgaaagaacacacatcgtgggaaagggagaacaaactggaactccccgcggtggcggccgctcaagcagagtcaagtgcccggggtggatgatttctggcaaccttacaaaaaagcacgactgctacggctacgtgcggatcctggaccggtccttggacatcatcatctccggctgggagaacatcagcaccatcgaggtggaggcggctctgttcgcgcacccagccgtgatggaggccgtagtggtggggcagctcgacgaatactggggggagacgccgggcgcattcatgacactcatgtagggctctgccggcagcgtgcccgccgaggaggtggtggcgttctgccacgcacacctgccgcggaaaatggcgccctagacagtggagttcattggccgaattgaccaagacattcacagggaaggtgcattaactccccccctcccggggataaggtccagggttcatggtacaacattccgcaagcttccgtatcattagggatgagggcactgggacaaaaaaacccaaagcttttgaatcaacaacttcagcaatggccccataatgggaattgcaatccctacaaatgtttcacgtgggtgggaagctaaactttgaattggtgcgaaataaataccaccctgaacctagcatggaatagaatcgcggcgctttgagcgagataccgatatttaatgggagcgacaggattggtcagcctcaacggttcatagaaaatcatagccaatgcatacatattataagacaatgtaatttatgaaacagagatattgtccagagggttgtatgtgtcttctcagctatctattgtcccagaagagcgttcttgagatgcagggcgtncttgccgagagggcgacgatgtacggacataagagatagcgttagagtatgtctgttaattataaatcttgtggtgtagtgcacacaaaatatgtattatatgtgtgcacaactttcattttcactgcggtagtaaatctatttatgtcaaagatgaccatacagtnattgtccccacagaacatatatattgtatatacaatagcttattggaacggtggcgataaagctcccgccgatataatatacaaatgtcatgggtgagaaaaccatatatttatactaactcaaaaggccatacatgatcccacaccatcttctttcctgtaacaggaacgaaatggaaattacaggcagaatatgtagtgatcatttgtagaaatagaatagag

SEQ ID NO: 88854 - protein, 114 aa, Zea mays
  misc_feature: Ceres CLONE 1576307
  misc_feature: SWISSPROT Homolog: EC 6.2.1.26 o-succinylbenzoate--CoA ligase
  misc_feature (6)..(6): Xaa is any aa, unknown, or other
RRKFFXRGCFFTSERTHIVGKGEQTGTPRGGGRSSRVKCPGWMISGNLTKKHDCYGYVRILDRSLDIIISGWENISTIEVEAALFAHPAVMEAVVVGQLDEYWGETPGAFMTLM

SEQ ID NO: 88855 - DNA, 859 bp, Zea mays
  misc_feature: Ceres CLONE 1576310
tggagctccccgcggtggcggccgctctagaactagtggatcccccgggctgcaggaattcgtctcacccctagaaaaacttgatctcttcctgagctggaggactccatctttcgagccgcggacccggagaaacttggatctctaggccatccaagaaaaggtttactcattccttgctggtagcctactgcattgctgcctgcccccagatccgagctgccgcaagaagaaaggtggaatctttgctcgcctgctgcacaaatccgtccaaatttggggtttcttgagctgttcttgggagcgccgtgcttcatgtttttttttgggggaaaggtcgttttctttgctggggtagatgcgggagtgatgtcgaccactttatgagctttccccctgctattttggggtttagattcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgcgtcggccacggccgctcggggtcgcggcattcttggcacagcctgtgggcggagcagcaacagccgcatcggcagggccagggcctgggtccgggtctgggaggggccgcatcatcagcgtcaggggcggtgggcgaaactgccctcggaactgctgctggatgtgatatcaaaggttggagtcaacgaggcgacctggccggcgcggcgcaggtcgtggcatgcgcagccattttgcggtcgtggcgcgaggtccccaaggaggtg

SEQ ID NO: 88856 - DNA, 823 bp, Zea mays
  misc_feature: Ceres CLONE 1576311
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (132)..(132): n is a, c, t, g, unknown, or other
  misc_feature (135)..(135): n is a, c, t, g, unknown, or other
  misc_feature (138)..(138): n is a, c, t, g, unknown, or other
  misc_feature (143)..(143): n is a, c, t, g, unknown, or other
  misc_feature (146)..(146): n is a, c, t, g, unknown, or other
ggagctcaccgcggtggcggccgctctagtactagtggatcccccgggctgcaggtattcgtctcacccctagttatggcgccggtttctttttccttctttggttgaggaggggagatgggggaggnnntnaanganatgcnggncccgccgatccagctggccgacgaggtcgccaagcagcgcgctgccgcgcggagcttccgtgccgagtgctcctaactcgaggcccgcgacggacaagctggcggcgctgctgcggcccgcggcgcgggccccggagctctacgacctccccgcggcccgcatcttgaccggtgccacccatgcgctgtccagagcctctgccctcgccgcccagcgcgctcgggggcagcctgggctgcatcagtctacttcacaccccccccccccaccgggttaccccgaggccgtggcggtgctccacaccgacctctacgacgtcgcgtgggtgctcctcatctactcccccgccgccagcgtgcaacgcgaccacgactagtctcccggggctccccacaatctcgtagatcaagctgttccactgcgaggacgtggaccacgacttccaccgcgccacggtctgcggctgcgcccgctccttactggcgccgcgctccgactcgcccgcccccgacaacaaccactgtggcccccccctcctcgaggaagaccgctttgcccccctttcctacctggaccaacggcggcccttgcaatagacacatacctcccctcgggcctcggggctggcccggccgggtatgctaaaaaaccgacaactgaatttggtccccggttt

SEQ ID NO: 88857 - DNA, 842 bp, Zea mays
  misc_feature: Ceres CLONE 1576315
  misc_feature: Encodes the peptide sequence at SEQ ID NO. 88858
  misc_feature (546)..(546): n is a, c, t, g, unknown, or other
ctccccgcggtggcggccgctctagaactagtggatcccccgggctgcaggaattcgtctcacccctagaaaaagcactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttggtattcatgataagggatctgcatattgctaaacaaacacaagacatgggattttatgctggtttttgntggcgcttcatatatggtggggggagggcagtcttcttcaacgtatgggggaatcggggttgataagttatggaaggaaaccggttatcgaactgaccccttattgcaaaagttttctttcaaaacaagggttgggataaaccccaacctttgggatggggttaatcccccgaggccctgcttggaaatacaaggggggggtttccccggggccaatttagggggtttttggtccccaaaaagttggggcccaaaaaaaaaaaaaaaacaaccttggggggttttggggcgaaatt

SEQ ID NO: 88858 - protein, 112 aa, Zea mays
  misc_feature: Ceres CLONE 1576315
  misc_feature (92)..(92): Xaa is any aa, unknown, or other
MGGGNGETTQLGEPLLAKKAKAYRPRCPGCRVDRLNAEREGVFPLKDLFLIWLVTITCTLPIQSLFPFLVFMIRDLHIAKQTQDMGFYAGFXWRFIYGGGRAVFFNVWGNRG

SEQ ID NO: 88859 - DNA, 821 bp, Zea mays
  misc_feature: Ceres CLONE 1576317
  misc_feature: Encodes the peptide sequence at SEQ ID NO. 88860
ctggagctccccgcggtggcggccgctctagaactagtggatcccccgggctgcaggaattcgtctcacccctagaaaaaaacaccacccacctccatagcagcctactatcctctccttcctccattctctcgctatcttccccactccccagccaacaaatcgaccttgctgggaacgagagggctatagagcctggggagggcagcgcaacacgcgccacggagcagcggcggcggcggcggcggcagagcagtccgccgggagcagaggccgcgcgcgcagcgcaggcagccatgggcgcgccggtgaacggcgccgtcgtcttgttcctcctgctgctggctggaacgggggcggtgaccgaggagacggctccgcaggaacccacattgcccgccgccggctccggctccggctccggcgccggcgccggcgcggcggtcggggtcaactccaactccgtgctggtcgcgctgctcgactcgcactacaccgagcttgcggagctggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaggtcgctgcaggcgctgctgctctacaacgtcctgccctcgcgcctgcccctcgggctcgtggcccgtggcccccgaccccaagctcttcggggaggacgtcgaagcttcgcctcggccggcgcccgcgggcatggcccgtcggccaacgccgcgttaaagcggcct

SEQ ID NO: 88860 - protein, 175 aa, Zea mays
  misc_feature: Ceres CLONE 1576317
  misc_feature (65)..(175): Pfam Name: Fasciclin Pfam Description: Fasciclin domain
MGAPVNGAVVLFLLLLAGTGAVTEETAPQEPTLPAAGSGSGSGAGAGAAVGVNSNSVLVALLDSHYTELAELVEKALLLQTLEDAVGKHNVTIFAPRNEALERDLDPEFKRFLLEPRNLRSLQALLLYNVLPSRLPLGLVARGPRPQALRGGRRSFASAGARGHGPSANAALKRP

SEQ ID NO: 88861 - DNA, 801 bp, Zea mays
  misc_feature: Ceres CLONE 1576320
  misc_feature: Encodes the peptide sequence at SEQ ID NO. 88862
aaagctggagctccccgcggtggcggccgctctagaactagtggatcccccgggctgcaggaattcgtctcacccctagaaaaaacacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccaggcggtcctcaaaatataagcccaaggattgggactccccaagataaggaaggaaatggattgataggagggaaaaagctggggtagtccttcggtacacacaaaatgtatttatgcttaaacggggaaattggtaacagaggaagatgttattactggggccagcccggtgagaaaccttaagtccctgaattttggttcggaacaaaaaatttgccccgtgggaacaaagccaataaattccctt

SEQ ID NO: 88862 - protein, 148 aa, Zea mays
  misc_feature: Ceres CLONE 1576320
MAALQPSFSPAMTLKSSCSALKFPKTALLSGFGGIPRLQDAQDRNTSVAYLIPKAASVTDQSIAEPPKTKQNRHTVDPTAPEFLPLPSFEECFPRSTKESSEIIHEESGHVLKVPFRRVHLTGDQKHFDTYDTRRSSKYKPKDWDSPR

SEQ ID NO: 88863 - DNA, 947 bp, Zea mays
  misc_feature: Ceres CLONE 1576325
  misc_feature: Encodes the peptide sequence at SEQ ID NO. 88864
  misc_feature (300)..(300): n is a, c, t, g, unknown, or other
ctggagctccccgcggtggcggccgctctagaactagtggatcccccgggctgcaggaattcgtctcacccctagaaaaagagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaagggggcgggtgggtggacccnaccgcctccaacctcaccgccttccccccgaagccgaacgggatcttcgcgtccgaccggcccatcgacgtggacgccgccacggaggccgagctgcgtcacaacgggttccggagtacgcgccacaacaagctcgtctgcaccgtgggccccgccacctcgcgcccggaccagctcgaggcgctcgccgtcggcgggatgaacgttgcccggctcaacatgtgccacggcgacagggagtggcacagggccgcaatccgcgccgtggggagcctcaacgaggagaagggcttcgccgtcgccgtcatgatggacaccgagggcagcgagatccacatgggggacctcggcggcgcgtcctcagtcaaggcggaagatggagaagtatggacgttcagggttagatcatttgaaattgctctcccagaacgaactatgaatgggaactacgatggatttgctaaaaaagtgaaaatttggagaagagctccttgtggaatggggaaatggcttcatttgaggggatttgaaagaataggaccgaattttagtggccgttgaaacgaatcctggtttattggtgccacggcgcatacctacattctgggcgagggggccatttcgaccagggaaataaatggtatcgc

SEQ ID NO: 88864 - protein, 120 aa, Zea mays
  misc_feature: Ceres CLONE 1576325
  misc_feature: SWISSPROT Homolog: EC 2.7.1.40 Pyruvate kinase
MNVARLNMCHGDREWHRAAIRAVGSLNEEKGFAVAVMMDTEGSEIHMGDLGGASSVKAEDGEVWTFRVRSFEIALPERTMNGNYDGFAKKVKIWRRAPCGMGKWLHLRGFERIGPNFSGR

SEQ ID NO: 88865 - DNA, 810 bp, Zea mays
  misc_feature: Ceres CLONE 1576326
  misc_feature: Encodes the peptide sequence at SEQ ID NO. 88866
  misc_feature (760)..(760): n is a, c, t, g, unknown, or other
gcggtggcggccgctctagaactagtggatcccccgggctgcaggaattcgtctcacccctagaaaaatccgcaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctccgcgttcctggtcgtcttcgtcggcaccgtgtacgtgatgtcgcgccccaggccggtgtacctggtggactacgcctgctacaagccccccgccagctgccgcgtgcccttcgccaccttcatggagcacacgcgcctcatcagcgacgacgacaagagcgtgcgcttccagaccaggatcctggagcgctcggggctcggcgaggacacgtgcctccccgccgccaaccactacatcccgcccaaccccagcagggaggtcctcgcgcgccgaggcgcaactcgtcatcttcttcggcatcgacgacttcgntctgccgaacggggctcaaggcccaggacatcaacaccttcctcgtcaaa

SEQ ID NO: 88866 - protein, 188 aa, Zea mays
  misc_feature: Ceres CLONE 1576326
  misc_feature (79)..(184): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MPSGSVFSGSVNLKHVKLGYQYLVNHFLTLLLVPVMAATALELARLGPGELLSLWRSLELDLVHILCSAFLVVFVGTVYVMSRPRPVYLVDYACYKPPASCRVPFATFMEHTRLISDDDKSVRFQTRILERSGLGEDTCLPAANHYIPPNPSREVLARRGATRHLLRHRRLRSAERGSRPRTSTPSSS

SEQ ID NO: 88867 - DNA, 1056 bp, Zea mays
  misc_feature: Ceres CLONE 1576327
  misc_feature: Encodes the peptide sequence at SEQ ID NO. 88868
  misc_feature (12)..(12): n is a, c, t, g, unknown, or other
  misc_feature (14)..(14): n is a, c, t, g, unknown, or other
  misc_feature (16)..(16): n is a, c, t, g, unknown, or other
  misc_feature (50)..(50): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (70)..(70): n is a, c, t, g, unknown, or other
  misc_feature (878)..(878): n is a, c, t, g, unknown, or other
ggggttgttttncngnataggtagatgttggggtccttttttttttttanaaccaggnnnnnggtttntntttaatgctggagctccccgcggtggcggccgctctagaactagtggatcccccgggctgcaggaattcgtctcacccctagaaaaactccgtcccacacacgcgcgccgcagcctccgcagtccgcacctgcctccacgacctgtcgtgctcgtgcgctactctcctcgagcgcggcgcggagcacggggacatcaaatggcggcagcggcggagatcggtggtttcgcggcggcgagagtggcggtggcaacgctcaggccggctgcgcacccagccccggcggcggcggcggcaccgcagcctaggagggcggtggcggcgcagtcgctgcagacgaccgccaccgaggcgctgacgggcggatctcggccggcacgaccaaacggcgcctgtggaatgcctcgggaatgaaaaagtaaagggcttccaaagggaaaaatcccttttcccaaggggcaagtttaaccgggaaaaatttccttgggggggaaaaaggacccaaagggttttggttcctgggccacccccaaaagaggggttcccccttccaaaaaacaaaaaaaacacccttccgggagaaaaaaataatatatttttgggaaaaaaaccctctctttcccaaaaaaaaaaaaatcttgggggaaaaaaaaaaaaaaaagggttggggcgcccgcccgcccccctcccccaaaaaaaaaaaaaaaagggccccccccacaccgggggggggggggagaaacacacccccaccacatgtttttcccccccgcgcccccaaaaaagggggtgttttttttgttttttntttgtggcgtccccgggggggggatgtttaacttgcgtggcgccaataaaaaaaaaacaacattggggtgggggggggcattatattttttttttttttttccacccaaatttatttgggggggggaggaaccaaaaacaaaagggggggcgcccgtccaaaataaaaaaaataaaaa

SEQ ID NO: 88868 - protein, 71 aa, Zea mays
  misc_feature: Ceres CLONE 1576327
MAAAAEIGGFAAARVAVATLRPAAHPAPAAAAAPQPRRAVAAQSLQTTATEALTGGSRPARPNGACGMPRE

SEQ ID NO: 88869 - DNA, 900 bp, Zea mays
  misc_feature: Ceres CLONE 1576330
  misc_feature: Encodes the peptide sequence at SEQ ID NO. 88870
ggagctccccgcggtggcggccgctctagaactagtggatcccccgggctgcaggaattcgtctcacccctagaaaaaaaaaagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcgggtgggccccatcgccccggaaatcttcgggaagatgggcaatcatcccgcctggagaccgctctgcccggggttcaagaagggggggcaatccggcccggggggcaccctaacaaactaactggggccgaaactcctaaaacgcctctattgtccttccaacatggcggccttctggggctttcggcggaaacagccgccgggccccccggaaacgggtaacaaccccggggcttcctttggggcaaagcaagatccttccctcggcccttccaaaaagttccctcggccgggttccggggaaaacctgttccaaaccccgggggggggccccttttttaaaacccgctttgggcttttgggccaagccccaagaaagggggaatgtaatgaagccccaatgtctcaaggg

SEQ ID NO: 88870 - protein, 178 aa, Zea mays
  misc_feature: Ceres CLONE 1576330
  misc_feature (55)..(161): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAGGPHRPGNLREDGQSSRLETALPGVQEGGAIRPGGHPNKLTGAETPKTPLLSFQHGGLLGLSAETAAGPPGNG

SEQ ID NO: 88871 - DNA, 800 bp, Zea mays
  misc_feature: Ceres CLONE 1576333
  misc_feature: Encodes the peptide sequence at SEQ ID NO. 88872
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttcctgttccccactggcaacgctaccgaagagagcttagacggggcgtcgccgctgcgaa

SEQ ID NO: 88872 - protein, 210 aa, Zea mays
  misc_feature: Ceres CLONE 1576333
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVTRPAAAAGDGEDPGVAAWRARDLDEAISSLFLFPTGNATEESLDGASPLR

SEQ ID NO: 88873 - DNA, 943 bp, Zea mays
  misc_feature: Ceres CLONE 1576334
  misc_feature (839)..(839): n is a, c, t, g, unknown, or other
  misc_feature (840)..(840): n is a, c, t, g, unknown, or other
  misc_feature (855)..(855): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaaaatttgcgttcccactcccaccaccgcttcttcccgtatcccttgtcctccctaatttcctctcacaaaaagcgggtgcggcttcctgccactcacctcggtctcggggggcgcccgtgctgctggtttcgctccaggggagaaggggcagagggagtagagcaggttaggtccgtttgcgttttcttttgcgggtttgtaggtcaaaagctccgcgagcactttccgctccacctcctcacgctcggaatcaaatcgatgcccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcgggccgttatggggtgaaccgaagcgttcctcgcagggctgtgggtttattacgccgcctgtttgcttccccgcaccttgtccttgtgcccatacttctttgcttttgtcacgcctgaaccgtgtcttcttgtagtatctgaagcttggcagttggcaagtacaaactagcaacttgcttaggtataaagtataaaccagtgtctggtgcagagcccaaggggtcacgaaatcgtgatgcatagatctgcttctggctgagataaggctctaagtcgctctgttgatggggcgacatgaacaccggaacnnggatgtgaatctgtncaagtggaaaagtggcagcancgtcgctgcaatgccagcctaggccgatgatgtgctcatgacggcagctcgcgcgtttcttacaaaa

SEQ ID NO: 88874 - DNA, 1117 bp, Zea mays
  misc_feature: Ceres CLONE 1576335
  misc_feature: Encodes the peptide sequence at SEQ ID NO. 88875
  misc_feature (14)..(14): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (68)..(68): n is a, c, t, g, unknown, or other
  misc_feature (69)..(69): n is a, c, t, g, unknown, or other
cctctttacccacngttgtcatgaggacaaagaacaccacacctccctccccnnnnaaaaaaaaaaannccaaactggagctccccgcggtggcggccgctctagaatagtggatcccccgggctgcaggaattcgtctcacccctagaaaaatcggagggcgagatctacgccacactctgcgactgcggaatggaccccaacatagccgtcaagaggctcatctcccacgatacttttcatgaagtcagaagaaagcgggataggaaaaaggagactaaagttaatcacgaaacaaggcctcgacctttccagaaatatacataccgaggatataaggctgtttcagatcgaagtgggcgagaccctacaagcggtatcaaaagccctgtaaagaaggaaccagagttgcaagctccactaaactcatcagccttggatgtcaagacaagggacactacagaaatattttctgctactatcaatgttgcccagactgatgctaagaacaccacttctcacccctttatctaaagtgccccatggttgggggtggcatttccaagtcggaccatcccatggcatgaaaataagagaaaattgggcaagggccctcaaggcttaaaagttaggggagccattattctgcatggcaaaggaaaacaacttgccggttagccccaacccggtatgggtaggattataagattaaattcttcgccaaatgagcccccaaaaaaatcctttgtgtggccccccaggagggaaatatgagtcaccagaggcaaaccgtggtttttgttttggcaatttcatgaaattgcgggggcctccctgttgctgcccatgccggaaaaataaaattttgcaccaagaaccgggggagcctggctttgtggggagggcccacttctacttaaaccattaaagaagaattcgctttaccggggaaattatacaaaaatgtgtacaccgcccaccaacctcaaaaaggggaataagaaattgttttgtaaagagccccccttttccaaagaaagagcgtatagtggcaaccaggggtgtttaaataaatgtggccccagaacgccgaatatgaacaaaaaaacagatgggg

SEQ ID NO: 88875 - protein, 113 aa, Zea mays
  misc_feature: Ceres CLONE 1576335
MDPNIAVKRLISHDTFHEVRRKRDRKKETKVNHETRPRPFQKYTYRGYKAVSDRSGRDPTSGIKSPVKKEPELQAPLNSSALDVKTRDTTEIFSATINVAQTDAKNTTSHPFI

SEQ ID NO: 88876 - DNA, 1118 bp, Zea mays
  misc_feature: Ceres CLONE 1576336
  misc_feature (1)..(1): n is a, c, t, g, unknown, or other
ntttgttgtggtggtgtgtattaatattattggcgaggaaggagaatgggagggggggtttttgagtgttttgttttagctggagctcaccgcggtggcggccgctctagaactagtggatcccccgggctgcaggaattcgtctcacccctagaaaaaaaacgggagggtgggcgagcctgctcttcctgtctgggagagagaccgaagaagaggagagagaggcgctgcgcagcgcatgctcgcatctcccccctccccttgccggctggcccctgctgcagctctgctccgagtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactccccggctggtctgctgcggacacccctgccccgattcaccctccgctgcttccctgcctctaatatattcgccccgcctcggtcggccgccggaccccgaccacaagaaagggccttcccagaaaaccctccggaaccccttaacccttccggattccgggcccccggctccaagtggttacctttccttccccgggggcccggggccagaaacctccccgaattggggcccgttcccgtttcggaaagggccccagcgccggcccaatatcccggataacccaaaccggttcccgggggggcccccgagaccgtgggttttccccatgggaatatggataggtgccaccccccgtggggtgctccccggggcgcctgcctttgggggcgcccctttgggcgccgccccataaaataccccccggggggttaacgcgcgcctaaaattatttcgggggggaattctctggggagagggaacctcgggcttctctccacaaaggccgcctaaaacccccccattgggggccggaaagagaaagttttgagtttacacgaggcctttctccactctgtggggttttgcccgcggggcgcgccccttttaaggggcgcgggagagggggttcttttcccacgggagtggccctattaggggt

SEQ ID NO: 88877 - DNA, 962 bp, Zea mays
  misc_feature: Ceres CLONE 1576338
  misc_feature: Translation starting site: 220
  misc_feature: SWISSPROT Homolog: EC 6.1.1.22 Asparagine--tRNA ligase
  misc_feature (400)..(400): n is a, c, t, g, unknown, or other
  misc_feature (496)..(496): n is a, c, t, g, unknown, or other
  misc_feature (499)..(499): n is a, c, t, g, unknown, or other
ctggagctccccgcggtggcggccgctctagaactagtggatcccccgggctgcaggaattcgtctcacccctagaaaaaaagccacaaatatttgcaagccacaagccaagccaagcaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggtgaagggctctttcnccttcctggagctcagcgacgggtcctgcgctgccacgcttcatggcatcgttgacgccgccgtgcacccgctagcgcgcctcacctggcacgggnacntccgtcctcgtcgagggcgtgatcaaagagccgcccgaagggaccaagcagaacgtcgagctgatgggcagccgcgtgcttgaggtcggccaagtccatgcccccgtctaccggctggccaagggaaggccaaaccacgctcgaaaaagccagggacctcgttcatctccggtccggcaccaaaccaatttggagcggttgctaggattgggccccagttagcctttgccttccaaagggtccttggaaaaaaaaggggattccccttggccccccccccattataaccccccattgccctggaaaggggcccgggaaaatttttcaaaggaacactttttttttcccggggggaaaaaacggggaagggttggggaggaaccccaacacctttgttttttaatatgtggggcccataaatcctcttaagaaaaaaaaggtgggggcgcccccctttaaagag

SEQ ID NO: 88878 - DNA, 1036 bp, Zea mays
  misc_feature: Ceres CLONE 1576341
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (1036)..(1036): n is a, c, t, g, unknown, or other
tggagctccccgcggtggcggccgctctagaactagtggatcccccgggctgcttgaattcgtctcacccctagaaaaagtggactcctactcctactcctactcctactcctactctctccccttcctcccgttgattgattgaggggattgctactaggcgggcgctagcactgcaaagcatctcgcctcatcgtctcctccgtgctccacttgcccattcttacgcgctaagcaacaggccagccggccgtagctccaaagcgggagccggagccggagccgggagctaaggggggccctgatgtcttcattccccacaggacgcgccgggccgaccactccattgggttcgcctggcaacccaacaaaatcggccgccgggaggccggtccgccccccccaccggcgggggcccagggcttccaagggcccaaccccttaaaaggcggtaaccaagccggtcccctagccggggttcgggggccggaaaacccccccttcggtttctcgggccccccgcggccgtttcttctccccccccggggggagctcccctccttggggggtggagggcccctttccttttcccccttttttgtgcccccccagagaaaaatttccccggcgaaaactcctcgcggggggcgcgggcccatattttgaaaaaaaaaacacccggttttctcccgcccccccaatttttttctcctcgtagggaaagaggggggggcaacgggtgttctctcccccccccataattttcctggggggggggcggggggggaaaaaaatataggggtggatattctccaaaaattaatacttttccaaaaaagggaaaatttatgtttcacgagaggaggggtagggttacattattttnnncacccccacactgtgcttctaagagggggcaataaagaattattgcttggggggggctatttaagacgtaaagatgagcccgtctttggggaattttttctaagaaaaaaaaataacctcctctttggtccttccggggaggaattcn

SEQ ID NO: 88879 - DNA, 1261 bp, Zea mays
  misc_feature: Ceres CLONE 1576342
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (1003)..(1003): n is a, c, t, g, unknown, or other
actttgatcaaacacacgaaagcacgcactaaatatattatnctnnnnnnnnnnnggntnnncataactggaactccccgcggtggcggccgctctagaatagtggatcccccgggctgcaggaattcgtctcacccctagaaaaaaagccacaaatattggcaagccacatgccaagccaagcaaaagcctaagaaacccaccctccctccagtctcctcgacccccgccgccgccgccgccatcacaacccagagcaccccctccccaccccaccctgtcccgatggctgcggacgccgccgctggggcgatgtgcgagacttccctctgacgacaatctccagccggccaccgtgcccaaccgcatccgacaatgtccggggcgaaggtggcgggcgttgccggggatcgcatcgagcaccaaatcgaaggttctgaaatgtttttaaacaagaaaaaaccccccccccccctcctgggagctatgtaaaggatcactgagctgccaagcctttgggccgttgtttaaggctgcccatgtaaccagtttttggcggggtgggaactcaacgggaaatctcccatccctccgcaaggggggggtgacccaaggtagtccccccccatgggaggactctagccgaaaacggttgtgccctaaaggggccccccccccgggtcttggaaagattcggggggaagtggccaatgtccggctgagatttatcccgccttttcgccaaagggagaatgggggctaaaaacccaccaggaccggaaaaaaaccgcctgggggaggcggcgagtgtcatagccttcccgtgttgccggcaagcacccaggccgctctgagttggatgaggcggggggcgtcacgagaaataagtgaggcccccacctttaaacaccccttgtggcgttccaccaccgtacgtttctcttgtatatatacagaaggtggatatctctctcctgcgtgcgggcccacccccctcatattngtggatccatctccgtttgagatctatttctaggggtcaccaggtacgattaatttattctctacagtaggagattgtttatgtttgtgctcgcacttggtcggacatacactcagtttacgtaagatttggcgatgacatcccatcacactctctgttgtactatttgctgcatatctacgcgacgcacttgaagacttccttctccacaagcgactaaatggtgcgtgtgggtcgtgccactcgaccacctcacac

SEQ ID NO: 88880 - DNA, 770 bp, Zea mays
  misc_feature: Ceres CLONE 1576349
  misc_feature: Encodes the peptide sequence at SEQ ID NO. 88881
ctggagctccccgcggtggcggccgctctagaactagtggatcccccgggctgcaggaattcgtctcacccctagaaaaagatcctgagtgagttctgaccatgcctttgagacttcaagtgggcaacgtttctcgcctctcagcgcaaaaagatagatcctctgctctaccggcctaccacgttcgtctcccgcgccggccacccaccgctgccaccgaggctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgcggcgcaagcggcggtcccggcggcggcttggttcatcgagtgacgaaagcgggagac

SEQ ID NO: 88881 - protein, 42 aa, Zea mays
  misc_feature: Ceres CLONE 1576349
MESGRLIFNAPGSGAGQMLFLDCGASGGPGGGLVHRVTKAGD

SEQ ID NO: 88882 - DNA, 864 bp, Zea mays
  misc_feature: Ceres CLONE 1576350
  misc_feature: Translation starting site: 165
  misc_feature (435)..(435): n is a, c, t, g, unknown, or other
  misc_feature (793)..(793): n is a, c, t, g, unknown, or other
  misc_feature (809)..(809): n is a, c, t, g, unknown, or other
ctggagctccccgcggtggcggccgctctagaactagtggatcccccgggctgcaggaattcgtctcacccctagaaaaactgcctaccccgtccctccccaagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacaggcaccgcagcggccgggagcaccgtgaccgggacaaggatgacgtgaaggaggagaggagccgcgaaagccgcgggaaggacagggacagggaggggnagagaacgggagaaggagaggggtgacaggcaccggctgagagagagggaagtggaacgggagcggaggagccggagccgctcggagcggcgccgtgccgaggaagaggagatggttagggagctggagcgggagcgcgagcgcagcgagcgacatcactatcgcgaccgtgatgtcagatatgatacgatagagccgtcttcagatggtatctgcaattgggcctgactcaagatatcaggcgtaggaaagatgacggggcagagccagaagttgatccagaaagggaccagaggactgtatttgccttccagctatctttgaaggcagacgagagagatgtttatgagttcttctncagggctgggaaaggntccgtgatgtcgtcttatcatggaccgggactcaagaggttctaaaggagttggg

SEQ ID NO: 88883 - DNA, 817 bp, Zea mays
  misc_feature: Ceres CLONE 1576351
  misc_feature: Encodes the peptide sequence at SEQ ID NO. 88884
  misc_feature (606)..(606): n is a, c, t, g, unknown, or other
gcggtggcggccgctctagaactagtggatcccccgggctgcaggaattcgtctcacccctagaaaaaacactccaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgactacctagaacatatatctgaaaagtttgagttcagtgcagacnacattgaacccctggtccagacctgcatgacaactctatcctcaaagattgtaaccgttgcaaggcggcgttggcagagaatgctgtcaaagcagtacttgccggttgcagatttggagagggaggatgtttaacttggatctaattaaagtagaagggaaggtttgttggggaagctggaggacactgaactttttttttgggatttatg

SEQ ID NO: 88884 - protein, 200 aa, Zea mays
  misc_feature: Ceres CLONE 1576351
  misc_feature (157)..(157): Xaa is any aa, unknown, or other
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDYLEHISEKFEFSADXIEPLVQTCMTTLSSKIVTVARRRWQRMLSKQYLPVADLEREDV

SEQ ID NO: 88885 - DNA, 898 bp, Zea mays
  misc_feature: Ceres CLONE 1576352
  misc_feature: Encodes the peptide sequence at SEQ ID NO. 88886
tggagctccccgcggtggcggccgctctagaactagtggatcccccgggctgcaggaattcgtctcacccctagaaaaaatcccccctccactccccccctgggttttccccttcctttaccccccatcagatcttcccccatatctctgtcctgcatcactcgccgccatccactcccgatccaaacccgagagctcccacctccgccgccctgttcgctcgtccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctacaacggcctcgccgtccgtcgtggtggtggtggatggtggtgtgcacacagcttggaggagaatgttccaaaaaaccaaccaggaaacccgtgaggcggtgctgcctcttcgactctagagaattcaggggtggacacggtgagatcctaaggattcgatccaggcccgctagaataaaaacaaatcagaaacagtaccccagaatcctctgcggtgtgattcgaggccatgccccgttcctgggaggaggggagagtgaagacgaccggaagcacaaagggtccaagtggcgtgagacttgtgagacggcaggccgccattaccacgggtctaagatatttgagaagaggtgtgggattggggccggggtggggcggggaggactctcaatagtaccaatagggaatgttttaggaataacgccatacttcgggcaggggatcatatgtggtatcaccatcctgcccggtgacctaaagtttgctattgttgta

SEQ ID NO: 88886 - protein, 154 aa, Zea mays
  misc_feature: Ceres CLONE 1576352
MVVCTQLGGECSKKPTRKPVRRCCLFDSREFRGGHGEILRIRSRPARIKTNQKQYPRILCGVIRGHAPFLGGGESEDDRKHKGSKWRETCETAGRHYHGSKIFEKRCGIGAGVGRGGLSIVPIGNVLGITPYFGQGIICGITILPGDLKFAIVV

SEQ ID NO: 88887 - DNA, 917 bp, Zea mays
  misc_feature: Ceres CLONE 1576353
  misc_feature: Translation starting site: 175
  misc_feature (878)..(878): n is a, c, t, g, unknown, or other
ggagctccccgcggtggcggccgctctagaactagtggatcccccgggctgcaggaattcgtctcacccttgaaaaaaccgagcagcaacaagccaacaactaaaggcaggcgcggcacaccgcgacaccgtaccggcctagacacttggagaaaggagaagcagcgcagcggcatgggcaccagtcccgtcatccctgcgacgatgctcgtcgtcgctctccttgtcgctagtaatactgtctgcttcggcgccaccgccaccgacaccgacaccgacggcgccattcgtctccccagcagctctggtgctgttggtcgaccgtgggagtgctgtgactatgtcacaaggagccgtttatcaggccgccccggtggcgctgcaacgacgtggtggacaactgctccgccgactgccaagagtgcgaggagtcgccggccggcgaacgcttcgtctgccgtgactggatcttcagcctgctcgagcccccggtctgcatacccaggccgtgggactgctgcgacttcgcccgtcggcgcaagggaatacatcccctattgccattgcgggtacctgggtggagtccgtgccccagccagggcaaaacgtggcaaggttgtgggagtcggaacctccctcgctaccgaaggcccaaaagtttttccacgggctattccgggtccccaggtggaccgcccggggatccgttagaagcaatttagcttaaggtgagggtacttggggtaattgaataaaataaaaggttacccgaggcttcaattaaatttctaatgtgcttaggaacgctcccccaataaattaaataaaacgcggcttggggaaaaaaacctaaacacctggtttgatttggccccgantccccaaactctttttctggcaatctgcaggtgcaataa

SEQ ID NO: 88888 - DNA, 848 bp, Zea mays
  misc_feature: Ceres CLONE 1576354
  misc_feature: Encodes the peptide sequence at SEQ ID NO. 88889
ctggagctccccgcggtggcggccgctctagaactagtggatcccccgggctgcaggaattcgtctcacccctagaaaaagagaaaaatcaaatcaggagacggggattccagagagccccgttcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttgcaatcagttcttgcgacaggagccaggtactgatcagcagatacaagactttgcttgcaccagatttaaagctgaatacccagtttttcagaaggtgcgcgtaaacggaccagatgcggcgccggtttacaagtttctgaaagctagcaagcctggtttgtttgggtcatcaaggatcaaatggaactttaccaagtttctggtggacaaagatgggaaggtcatcgagagatacggaacctcgacagctccaatggcaattgagaaggacatccagaaggcccttgaggaataattttttgtgagcttgtctcgtctcatccacacacacttgcagcagaaataggcacttgctgaaatatttcgtatctccagcggctttcttcccaagctcaactccgacgagaaccgcactccctcgaaatctcgaggattttctgcggcgaaccccttcgtgacgtgacccaa

SEQ ID NO: 88889 - protein, 170 aa, Zea mays
  misc_feature: Ceres CLONE 1576354
  misc_feature (12)..(120): Pfam Name: GSHPx Pfam Description: Glutathione peroxidase
  misc_feature: SWISSPROT Homolog: EC 1.11.1.12 Phospholipid-hydroperoxide glutathione peroxidase
MGAAESVPETSIHEFTVKDCNGKEVSLETYKGKVLLVVNVASKCGFTETNYTQLTELYQKYRDKDFEILAFPCNQFLRQEPGTDQQIQDFACTRFKAEYPVFQKVRVNGPDAAPVYKFLKASKPGLFGSSRIKWNFTKFLVDKDGKVIERYGTSTAPMAIEKDIQKALEE

SEQ ID NO: 88890 - DNA, 902 bp, Zea mays
  misc_feature: Ceres CLONE 1576359
  misc_feature: Encodes the peptide sequence at SEQ ID NO. 88891
ccgcggtggcggccgctctagaactagtggatcccccgggctgcaggaattcgtctcacccctagaaaaaaccgtcgcggtgtctccctctctctctctctcatacagcacaggtccaggtgtaggctgtagagggtggaataagcgaggtcgagtcacagaggcctgcagcaaccctctgcgctgaacatcgaggccacgctctgcaggctaatgactgctctccctcgataagccagggtccaagctagttctgcagaggaaccaacgaggacgctagtgtgagctctgagctctgactgaacacggagagattggccgcttctcatccatcgatggtagtgttgaggtggccatcttagccatgaaccagttcgaccctgattggagcaacatgggagacacctccaggccgctcggcgaagtaagacgacctcatcgagctgctctggtgcaacggccatgtcatcatgcagagccagatccaccggatagtgccaccgaggccggagaaggcggcggcagtggcggctccaccagcccccgcgttcgtgccgcacggaagacgagagcggcctgatggttccccttcgcgctggccgactcgctgaaaaggacatcttgtcggagttcttctgcgaggtaccgactcccgtatcggcggcggcggatgcggtgcacgcggcctctggtggcggaaccggatccaatccagaggaagtcgagatgccgggaccttccaatccaacataggactacaggaacagcggttgcggggcttcccctttgtcgagaagacgacccggctcacctgaagcgcctcaaaagtaaagacccgcaccctggtccgacatggtacaaaaagaaactgggcatgggggcaaaaatgccgtagggaactg

SEQ ID NO: 88891 - protein, 46 aa, Zea mays
  misc_feature: Ceres CLONE 1576359
MQSQIHRIVPPRPEKAAAVAAPPAPAFVPHGRRERPDGSPSRWPTR

SEQ ID NO: 88892 - DNA, 802 bp, Zea mays
  misc_feature: Ceres CLONE 1576360
  misc_feature: Encodes the peptide sequence at SEQ ID NO. 88893
tggagctcaccgcggtggcggccgctctagaactagtggatcccccgggctgcaggaattcgtctcacccctagaaaataccagggtgccttgcaatggcgacaaacagaagctctcgatctcacgcgacccgaggaagaagagacaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggccgtcttcctgaaggtggacgtggacgaagtgaaggaagtcaccgcggcctacgaggtcgaggcgatgcccaccttccacttcgtcaagaacggcaagacggtcgcgaccatcgtgggtgccaggaaggacgagctcctggcccagatcgagaagcatgccgcgcctgcgcctgcgtctgcgtctgcctaaaagagatcagtcgtcgccgtcaataagggccagcacgtatggctgtaaacgttgtcgttatcagttcaggctttgtcgtttgtgggcgattgggaactagtagtatggatgtttctatccgagccggaggccatacttaaccatggatacctgttggagagttcgtttcctgtcggcgtgtatctcccggaggacattatcatgtcgccgtcctcattcttccctcgctgctggagctcggggccccctcggaggaatccgtttttgggccacatgcgtaagccac

SEQ ID NO: 88893 - protein, 122 aa, Zea mays
  misc_feature: Ceres CLONE 1576360
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQAVFLKVDVDEVKEVTAAYEVEAMPTFHFVKNGKTVATIVGARKDELLAQIEKHAAPAPASASA

SEQ ID NO: 88894 - DNA, 889 bp, Zea mays
  misc_feature: Ceres CLONE 1576361
  misc_feature: Encodes the peptide sequence at SEQ ID NO. 88895
gctctagaactagtggatcccccgggctgcaggaattcgtctcacccctagaaaaaaccactcccttctcgcgacctcagaatctcacggcatcacgcgaagcaaggagaaagaaaatggcgcagctggtggagacgtacgcgtgctcgccggcgacggaacgcggccgtggaatcctcctggccggggaccccaagacggacacgatcgcctactgcaccggccgcagcgtcatcattcgccgcctcgatgcgcccctcgacacttgggtctaccccgaccacgcctaccccaccaccgtcgcccgcttctcccccaacggcgagtgggtcgcctccgccgacgcctccggctgcgtccgcgtctggggccgctacggcgaccgcgcgctcaagggcgagtttcgccccctctcgggacgcgtcgacgacctccgctggtccccggacgggcttacgcatccttgtctccggggaccgcaaagggcaagtcctttcgtccggcgcatttcgtatgggaactctgggcccgccccgttgggtgaagtttgaatggggcactccaaaagaggggttcttgaagctggggaatttcaaggccaaacaccgtccaattttcgcatttggggaaccaggggggggaaagaattttttttggggctacactttttttggaagggaccgccccatttcaaaattcagggcgtttcccctagggggaatccctcccaaatttttggttaaactgggtatcccgcggtagtcctccgtgtgggtaagtaggtgttttttccctgtgggattttcttaataataaaggggcttggccaattttggtgggcaaaactgggggagataaaaatgcgggaaggctttttcccgtgaggggg

SEQ ID NO: 88895 - protein, 144 aa, Zea mays
  misc_feature: Ceres CLONE 1576361
MAQLVETYACSPATERGRGILLAGDPKTDTIAYCTGRSVIIRRLDAPLDTWVYPDHAYPTTVARFSPNGEWVASADASGCVRVWGRYGDRALKGEFRPLSGRVDDLRWSPDGLTHPCLRGPQRASPFVRRISYGNSGPAPLGEV

SEQ ID NO: 88896 - DNA, 1176 bp, Zea mays
  misc_feature: Ceres CLONE 1576362
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (63)..(63): n is a, c, t, g, unknown, or other
  misc_feature (67)..(67): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (970)..(970): n is a, c, t, g, unknown, or other
  misc_feature (1176)..(1176): n is a, c, t, g, unknown, or other
ggtggtttgggntgggnngttgaaccgaacggtaatatgatatgtgcacaggaggggaaaagngggngggnnntctaaactgggactccccgcggtggcggccgctctagaactagtggatcccccgggctgcaggaattcgtctcacccctagaaaaaaccgctctttcccgttcatgcatcacaccatgcccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcggccacaactgccgctcccgcggcttctcccgctcccgacgcgcaatcaagggcgcctgaaaactcaccccgccccacgcaacgctggggaaaccaaaaaacccctgggttccccggccccccccccgcgcctgttagctttttttgtaagggccgagaaaaccgcaccaacccaaaagggaaaaaacgggggagcgggaaaaattggggaggcccgcgtgatccacaaaaccgctgcttcattctcgtgtattcttactgcggttatacattaaggtgtcaaagtacccagtatagtgcgttcactcttctgtgcttgtgtgtggggggaggggtcggcgtgctctctacgacatgtgtaaatagtagtgaagataatgtttatctatcaatactctgttatttctatgaatgagttatattccagtatttggttgatattaatgagccacctacgtgaaaactacaacgcaattatcactgaacttgacggtacagggggtgaagggcatcaagtttgtgtccacgcctcgctaatttactctactctatctacgttgcaagcgaagtagaagttgtgagaaaaaaacgatctagaataaggggataccacagaagatccttatatcacatcngtcacacgcgcaaaggctgtacgggagctggtgcgaaacacatgagagttcttatcaacttctcgtgtgtcaacgagaaaagaatggaagctaagaggatcgatgaaggggctcgagtggggaggacgtgtcgggctgatgcgtgagacgcgtatgcacagtcacacatcctcgacatgcacgctgtcccctctgcttcacttaan

SEQ ID NO: 88897 - DNA, 897 bp, Zea mays
  misc_feature: Ceres CLONE 1576363
  misc_feature: Encodes the peptide sequence at SEQ ID NO. 88898
ccgctctagaactagtggatcccccgggctgcaggaattcgtctcacccctagaaaaaagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcaatttcgcccaactactctgcgaactacatctactggggcaaagggcagcatccgggctgcagctcatcaaccagcgctccgacttctcctttcgccctcttcaccggggggcctcagcaaccccgaggctgattcccggtgttccgacccccatatcctttcaaaaacccccaggcgccccctggttcccgccgcctgggcgccggggcacgttcccaccaaacaaaatgaacgggtgaacttggaacacacgggctaccgccctttcgattgaagggggtaccccgcttccgtgggaagggggggccgcccctggttctcccggttgagtaaggtggtgggggggcttcagtgtcatgaataaaaagatgagaggcgcggacactcgccctcgggagggcggtcttatctttttttattagcggtggggt

SEQ ID NO: 88898 - protein, 206 aa, Zea mays
  misc_feature: Ceres CLONE 1576363
MAVALLAALVASAAMFMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFRPTTLRTTSTGAKGSIRAAAHQPALRLLLSPSSPGGLSNPEADSRCSDPHILSKTPRRPLVPAAWAPGHVPTKQNERVNLEHTGYRPFD

SEQ ID NO: 88899 - DNA, 757 bp, Zea mays
  misc_feature: Ceres CLONE 1576364
  misc_feature: Encodes the peptide sequence at SEQ ID NO. 88900
  misc_feature (190)..(190): n is a, c, t, g, unknown, or other
  misc_feature (502)..(502): n is a, c, t, g, unknown, or other
  misc_feature (620)..(620): n is a, c, t, g, unknown, or other
  misc_feature (621)..(621): n is a, c, t, g, unknown, or other
  misc_feature (634)..(634): n is a, c, t, g, unknown, or other
  misc_feature (645)..(645): n is a, c, t, g, unknown, or other
  misc_feature (651)..(651): n is a, c, t, g, unknown, or other
  misc_feature (655)..(655): n is a, c, t, g, unknown, or other
  misc_feature (689)..(689): n is a, c, t, g, unknown, or other
  misc_feature (695)..(695): n is a, c, t, g, unknown, or other
  misc_feature (700)..(700): n is a, c, t, g, unknown, or other
  misc_feature (733)..(733): n is a, c, t, g, unknown, or other
  misc_feature (734)..(734): n is a, c, t, g, unknown, or other
ctggagctccaccgcggtgggcggccgctctagaactagtggatcccccgggctgcaggaattcgtctcacccctagaaaaagttccgcttcgtcccagcctctagttcttcctttcctccagagtgatggccaaatgctactcagattggcccccgattccgcctttccatccatcgcgaagaacgccngccgcaatcccacgcctccccgatcacgatcaggggcggcagctcgcgtcccttcgtggctccactggctccagaatcctgcgcctccccctccctcgaagcccaagaaaacctgcccgaaatgaagtttcgagggcccgtaacccgggggaaaacccccccccccccccccgctttgcccggaaacccccccccccccaaaaagttgggggggaattttcttaaaaaaaaagtgttttttcttcccgaagagggcccccctttggggggggggggggaaccccccccccaaaaaaaaaccccggggggacncccggggggggggcggccctttctttgaggggggggggggggctcataccagggggggaggggggggggggggcttctttttttttttttttttttaaacaccccccccccccacaannaacaataaaaatnttttttgtttnctttcnttantctccccccgccgcggcggtggtgggggcggggngtggtntcggnttgtggcggggtggggcggggcggagaaggaannaaaaaaaaaaattaggtacagaa

SEQ ID NO: 88900 - protein, 72 aa, Zea mays
  misc_feature: Ceres CLONE 1576364
  misc_feature (64)..(64): Xaa is any aa, unknown, or other
MKFRGPVTRGKTPPPPPALPGNPPPPKKLGGNFLKKKVFFLPEEGPPLGGGGEPPPQKKTPGGXPGGGRPFL

SEQ ID NO: 88901 - DNA, 855 bp, Zea mays
  misc_feature: Ceres CLONE 1576368
  misc_feature: Encodes the peptide sequence at SEQ ID NO. 88902
ccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggaaaatggatcaaacagtgatcttggttttgccaccgaaaatcggaatctgctccaggctgaataaacaccaagaaaaatttttcttcgcccatggaaacccaaaacagttttttctttgggtattgagcacagggggagatttcttcctttgggagaaatttgggcaactcctctggggggttttggagattttccccttaaaaaaagacccatatggggggggtggccctgtaatagccc

SEQ ID NO: 88902 - protein, 191 aa, Zea mays
  misc_feature: Ceres CLONE 1576368
  misc_feature: SWISSPROT Homolog: EC 1.1.1.86 Ketol-acid reductoisomerase
MAAATSSSTYLAIGRKTLSPAPSVATAATSVSFPATQHPCLVAASADRRRAVAAKVSSPSVIGTAMPSLDFETSVFKKEKVSLAGHEEYIVRGGRDLFPLLPEAFKGIKQIGVIGWGSQGPAQAQNLRDSLVEAKSDIVVKIGLRKGSKSFEEARAAGFTEESGTLGDIWENGSNSDLGFATENRNLLQAE

SEQ ID NO: 88903 - DNA, 953 bp, Zea mays
  misc_feature: Ceres CLONE 1576371
  misc_feature: Encodes the peptide sequence at SEQ ID NO. 88904
  misc_feature (904)..(904): n is a, c, t, g, unknown, or other
  misc_feature (953)..(953): n is a, c, t, g, unknown, or other
ctggagctccccgcggtggcggccgctctagaactagtggatcccccgggctgcaggaattcgtctcacccctagaaaaaatatctcgcctccacttcgtcacctcctcgccattctatcccaccagctgcatatatccctggtgtgtgaggtcagctgttttagctcagcgcgcgcggcgtggcagctaaggaagcaaggagggagagcagcggcggcggcgtagcatgcagcggtgagagcgagggagctagggatcttatagccgagagagcgagagccagaggatgatgcagctgccgcagcatcacaagccgtccgcccactcctgctgcccgtcgtggatccggaggtccccgccgtcgccgccgccgccgccgccgccgcacaagaagccgggcggcgggaggagccggtatgcttgccgcctcgtgcccctgctcgtgctcaccgtgtacagcgtcgtcaccgtgcttcgcatccccagcgcctccctcgtcgtctccaccgccgattcagagcgcgtggacaggcgggaggacttggaggcgctcatcaagacccacctgccgtcgaaccagaacagcctcgaggcccgcgaggagactctgtctgtggcctccctcccctgctccgccttcatcatcggtgaggcggggcacggcgtagagggcgtcctgtgctgcgaccggagccactaccgcagcgacgtgtgctacctgcgcggcgacgtgcgcacggacccgtccacctcgtctgtgctcctgtacacgcggtccgcgggatcggccccgagtatgtgctgccgtaccgcgcaagttcgatgacagcgtgatgagcagcatcgactatgtgaccatcgtgcccgtgcctgtctgccacacgcgagcgcagcgccctgcgncggcggtgcgacgtccggcaccgcgcggtgttgctgcggtgtgctctcn

SEQ ID NO: 88904 - protein, 179 aa, Zea mays
  misc_feature: Ceres CLONE 1576371
MMQLPQHHKPSAHSCCPSWIRRSPPSPPPPPPPHKKPGGGRSRYACRLVPLLVLTVYSVVTVLRIPSASLVVSTADSERVDRREDLEALIKTHLPSNQNSLEAREETLSVASLPCSAFIIGEAGHGVEGVLCCDRSHYRSDVCYLRGDVRTDPSTSSVLLYTRSAGSAPSMCCRTAQVR

SEQ ID NO: 88905 - DNA, 932 bp, Zea mays
  misc_feature: Ceres CLONE 1576379
  misc_feature: Encodes the peptide sequence at SEQ ID NO. 88906
gcggtggcggccgctctagaactagtggatcccccgggctgcaggaattcgtctcaccccctagaaaaatcgccgccttccactccacggttccacgtatcgcaagaattcaaataatttttgcgctctcgcgtcgatctgcttgaagcaagccccgaccggagccatggcttccgccaaggagagctatcgcgccgagctccgcgcctcctcccggcagctcggcgagcgttgcctctactccgccgctaaatgggccgccgagctgctcgtcggcgtagagctggatgggaccccggtcccttcggccgcgacggactccccatcctcctcgtccgcggcctccgcggggcggctattgcaccttcaccgtagcgggggttccagcttccgccaccgaccccgccccggcggcggcagtagctcggaggccgggaccccgctcggtggcgtgtcatacgtcagcacgcccatccccgacgacgacgcgttcgattcgggcggcgacaaatacctgctggccaagacctatttcgactgtcgggagtaccgccgcgccgcgcacgtgctgcagaaccaggttgggcgtaaggcagtgttcctgcgatgctacgcgctctacatggctggagagaagcgagaagaggcagagatgatagagcttgaaggattgttgggcaagagtaatgctgtttatcaggaactagttgctttggagaaagagctctcaacacaccgaagaactggctctattgattcatttggactccacttggatggcattgttcctcctgaataaggagtgaaggtctagcctaaaacaatcttagtagaatcggtcaatacttatccctgacaacgggagtgcttggccacagttacatccttttcgccccagcggggacattttaaacaccttaacccgaaaatca

SEQ ID NO: 88906 - protein, 210 aa, Zea mays
  misc_feature: Ceres CLONE 1576379
  misc_feature (1)..(181): Pfam Name: APC8 Pfam Description: Anaphase promoting complex subunit 8 / Cdc23
MASAKESYRAELRASSRQLGERCLYSAAKWAAELLVGVELDGTPVPSAATDSPSSSSAASAGRLLHLHRSGGSSFRHRPRPGGGSSSEAGTPLGGVSYVSTPIPDDDAFDSGGDKYLLAKTYFDCREYRRAAHVLQNQVGRKAVFLRCYALYMAGEKREEAEMIELEGLLGKSNAVYQELVALEKELSTHRRTGSIDSFGLHLDGIVPPE

SEQ ID NO: 88907 - DNA, 749 bp, Zea mays
  misc_feature: Ceres CLONE 1576381
  misc_feature: Encodes the peptide sequence at SEQ ID NO. 88908
gagctcaccgcggtggcggccgctctagaactagtggatcccccgggctgcaggaattcgtctcacccctagaaaaaaacaacaactggggagattcacccaagtccgtgctccacatctacaaggaactcattgcagccggactcagaatatgggtcttcaggtcctgttcatttccttacacacctcttggtttatatatttaatttcctctattatatatagtccataacgtaatcacagattgtttatttcatatgctcgatctcctcatgaatgctgataaatagtctgagtcgccccctcgtcgacctttaataataatagtgttcgataagattaggctgcctatacacacacgtcacccgtcgcgttatttctagtacaacggagcaagctaagagacgcaaagcagccacactggccggttgatgtcacctcatgacccacgcgcgtgtgcagctagcgcgctttgaccgctgcatatgggagatggccaaacgggccgtcctgcccggcccgtcctgggtccgggcccggtgaagtctggtgcgttatgggcccggctcgccagacacggttagaaaactgagccaaaccgtctaagcacgtgggctcaatttcatgtccgagcccggtccgctgcgggtctactggcccgtttagcacgaaaaaagcgggccaaaaagcgggctatgcgggccggtaaacacgtttttagtgtaaaaaaacaagtttaacggacttag

SEQ ID NO: 88908 - protein, 67 aa, Zea mays
  misc_feature: Ceres CLONE 1576381
  misc_feature: SWISSPROT Homolog: EC 3.4.16.6 Carboxypeptidase D
AHRGGGRSRTSGSPGLQEFVSPLEKNNNWGDSPKSVLHIYKELIAAGLRIWVFRSCSFPYTPLGLYI

SEQ ID NO: 88909 - DNA, 903 bp, Zea mays
  misc_feature: Ceres CLONE 1576385
  misc_feature: Encodes the peptide sequence at SEQ ID NO. 88910
ctggagctccccgcggtggcggccgctctagaactagtggatcccccgggctgcaggaattcgtctcacccctagaaaaagttcggacttccgccgacggcgttcgccctctcgctctggccgcttcacagcgcctccgctggcctctcctaccgctgcgagaatgctgttcaagaggttcgtggagatcgggcgcgtggccctggtgaactacggcaaatactatggccgcctcgtcgtcatcgtcgatgtggtcgaccacaacagggcacttgtggacgcccctgatatggtcaggtgccagattaacttcaaactgctctcacttactgacatgaagattgacatcaaacgcgttcgcaagaagtcaaccctgatcaaggctatggaggaagctgatgtcgagacgaagtgtgaaaacagctcatggggcaagaagctgattgtccagaacaagagggctgccctcagtgactttgacaggtttcaaggacatgctggcaaaggattaaaaagggtgggtgctattcggcaagaattcccccaatcttgaaagagggcgtcccccggcttaaattcccttttagggggaatggcatcgttaactttttgggtttcccgggttgcccccgcccttttggttttggggtgtttttcccaccccccaaattaggacaatttgttttgggggggggccctctttggaagaccgcccccttatacccccctgggttcggggggggggggaaaattttttttccccccgggggggggaaaggagaaaaaactcttttcccccccccagagggggtgccgaaaagggaaattccctccccccccaccccttttttatatgggcgcttaatccccccacacccaggaaaggggggggccgtttttttt

SEQ ID NO: 88910 - protein, 129 aa, Zea mays
  misc_feature: Ceres CLONE 1576385
  misc_feature (44)..(120): Pfam Name: Ribosomal_L14e Pfam Description: Ribosomal protein L14
MLFKRFVEIGRVALVNYGKYYGRLVVIVDVVDHNRALVDAPDMVRCQINFKLLSLTDMKIDIKRVRKKSTLIKAMEEADVETKCENSSWGKKLIVQNKRAALSDFDRFQGHAGKGLKRVGAIRQEFPQS

SEQ ID NO: 88911 - DNA, 914 bp, Zea mays
  misc_feature: Ceres CLONE 1576387
  misc_feature (684)..(684): n is a, c, t, g, unknown, or other
  misc_feature (769)..(769): n is a, c, t, g, unknown, or other
  misc_feature (792)..(792): n is a, c, t, g, unknown, or other
  misc_feature (802)..(802): n is a, c, t, g, unknown, or other
  misc_feature (805)..(805): n is a, c, t, g, unknown, or other
  misc_feature (806)..(806): n is a, c, t, g, unknown, or other
  misc_feature (818)..(818): n is a, c, t, g, unknown, or other
  misc_feature (894)..(894): n is a, c, t, g, unknown, or other
ggagctccccgcggtggcggccgctctagaactagtggatcccccgggctgcaggaattcgtctcacccctagaaaaagtcgtcgtctagctcccatccgacctcctgcattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttggctgcagatctggaagggtttcgtgggatccgtcgctacgatctgtcccagtcagagcatctgcatcatctcgggttgggccatggagactctgctcatctcggaggagcgcaaccaccagctccaccacttctcgggtcgccgtaagaaggcgttagcagcgtcgcctcagtccacgcgcagctaccatgcgggcaactgccgggcgttccactccggcatcacggtcggcatcctgccgtccccgcccgcgcagagggttgcactgacccgctcctctcctgagcccnagacaccgaaacatcagcttcaccatgggaaaaagcgcagccgagcaatctctatgaacctttcgacgtcccctccctctcgccntgagctctgggctggcccggggnttctgcattngcnngctccagctccntcccgatcccaagttctcactccaacagaagcgcagtgtctcactagaatttccacctgctgacggtcagacaacnaaaaagggcccgtgcatgcc

SEQ ID NO: 88912 - DNA, 849 bp, Zea mays
  misc_feature: Ceres CLONE 1576388
  misc_feature: Encodes the peptide sequence at SEQ ID NO. 88913
  misc_feature (463)..(463): n is a, c, t, g, unknown, or other
  misc_feature (772)..(772): n is a, c, t, g, unknown, or other
tggagctcaccgcggtggcggccgctctagaactagtggatcccccgggctgcaggaattcgtctcacccctagaaaaaaactcctgttaaaccctcgcctttccgccgcccgtcgcttcccccaaactatcgtgttcaccaccgacggcggcggcgaaacaccttgtcgccctctaccgaaatcccagcccaagcgtgagcgcccgctccccaccagtcaccatggcgccgcgctcccgcaagcgggcttcgcgccccaagccccgcccaggctcccgacgtggtggcggcggaggggacgacgaccccttcttcgagtccgcgcccaagcgccgccgcggggaccgtgacgaggacatagagagcgaggacagcgacgacgacggcgtggctgcgcttggccgcggatttgatgaggatggggacgagggcggtaaggaggatgaggacgaggaaacggtngggggagaagaagatgcggatagcgaaggagtggctgaagaaggtcactgaagtcgctaagagggggcaggaggatgacgatgaggatgagaacgtgtcgggagggagacgggtggcggagatcctgcagagaaagcagctcgaggagagcggcaggaagcggcgggagattgccgcgagggtattaccaccaggccctcaggatggctttaaggttcttgtgaagcaccggcaacctgttactgctgttgctttatccaaaggatagtgataagggggttttcaggatcaaaagatggaatcattatngcttggggatgttgaaactgggaaaatgtgagaagtatatatggccaaagtgaaaaaatgtgttggtttcacatcaa

SEQ ID NO: 88913 - protein, 105 aa, Zea mays
  misc_feature: Ceres CLONE 1576388
  misc_feature (17)..(17): Xaa is any aa, unknown, or other
MRMGTRAVRRMRTRKRXGEKKMRIAKEWLKKVTEVAKRGQEDDDEDENVSGGRRVAEILQRKQLEESGRKRREIAARVLPPGPQDGFKVLVKHRQPVTAVALSKG

SEQ ID NO: 88914 - DNA, 750 bp, Zea mays
  misc_feature: Ceres CLONE 1576395
  misc_feature (506)..(506): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (667)..(667): n is a, c, t, g, unknown, or other
  misc_feature (673)..(673): n is a, c, t, g, unknown, or other
tggagctccccgcggtggcggccgctctagaactagtggatcccccgggctgcaggaattcgtctcacccctagaaaaaatcgccccgaccaaagcttccccagacggcaggagacagcagcaggccggacgccggactcctcctccctcccccgtacgcatccactgactgagatccttcctgtgcgaaggaaatctccagttcttcggccccggccaggttttcaagtgttgcttgccccgccggagttttcctctaacccgcagtccaatttggctaagaaagttgatgggaatcggggggggacccctggaaaggcttgggtgaaaaatccccaaaagggggaacccggaaatttccttttttcagggggctttccccgcggaaaatttttgggtttgggcccctcttttttttttataaaaaaagttttttttttctgggagaaaaaccccccggggggggtatttcttcaaaaactctttggcagaaaaaaatattttcnaaaaaaaaaacccacccccccncnncctnnnnntnnngggggcgggggggggggggcccccccccccccccccaaaaaaattattatttttgctcgggggggggggggggggggggggatatattttttatttcttccctccccccccccccccccccccncatcanaataggggtggtgtttttttgtgtgagaaaaaaaaaaaagatacccccccccccctcccccccccccataaatttat

SEQ ID NO: 88915 - DNA, 1309 bp, Zea mays
  misc_feature: Ceres CLONE 1576397
  misc_feature: Encodes the peptide sequence at SEQ ID NO. 88916
  misc_feature (20)..(20): n is a, c, t, g, unknown, or other
  misc_feature (21)..(21): n is a, c, t, g, unknown, or other
  misc_feature (53)..(53): n is a, c, t, g, unknown, or other
  misc_feature (55)..(55): n is a, c, t, g, unknown, or other
  misc_feature (956)..(956): n is a, c, t, g, unknown, or other
tttggtcgtggtgaccacgnntggtggaggggaaataaatactgacaaaattnancaccattatataaaaagatgggactcccgcggtggcggccgctctaaactagtggatcccccgggctgcaggaattcgtctcacccctagaaaaatgtgaagaccctgactggaaaaccataaccctggaggttgagagctcggacaccatcgacaatgtgaaggcgaagatccaggacatggagggcatccccccggaccagcagcgtctgatcttcgccggcaaacagctggaggatggccgcaccttagcagactacaacatccaaaaggagagcaccctccaccttgtgctccgtcaccctggtggtcagtaagtcatgggtgcgtttaaactgcacaatgtgcctgcgtgatggggggcgctcctcaattgaaagttgcccaaatatctgctgtttcgtgccatgactccaggggaggggggattaaaaactggacccggttgaaatattagctgccttcttccccggggattgtgcgctaattctagcgaaacagtcttgtctggattgaaaagaaacttttccctcggcatctttggagactaccatagagtgaatcggagcggcctccgtcctactgtactagcctagcaggatagaggttgaaaaggcatccaactctaattgaccgcgggcgccgcctcttttcgcggaatcaggcgctcccatagcggtatcgccccatcgagacgatacaaggtggataaaataccacgctatcgtgctaccgcgaaagagatctatctctcggcttcgcgcgcttaggattcaagagtacgtggttgtttctccccccccactatcgctaagggggaagatacaaatacaattacaacctccctataagcacagtgagatggttcctcagaggaaagaaaaaaaaatatcgtattgangggggcgcgtgagtagtagatcgagatgggatagaatacgcgctcggtggtatcgttactgacataaccattcgtgataaaaaaaatgcgagatggaaacacggcctagagaggattcgttccctcacgccaacgtatataaacagagatttacggagtggagtccatcctccgtctgagagatcaagacatccgcgttctcctggtgtgtgatgatgccctcctggtctttcagtgactcggaggtcaaaaaatctctgacgtcgtgatagcgcgttgaaaatcctctgaatagagggaaaacaagttgaggagggtattgcgcttgctcagtaacctcggtgggcgctaag

SEQ ID NO: 88916 - protein, 45 aa, Zea mays
  misc_feature: Ceres CLONE 1576397
  misc_feature (2)..(42): Pfam Name: ubiquitin Pfam Description: Ubiquitin family
MEGIPPDQQRLIFAGKQLEDGRTLADYNIQKESTLHLVLRHPGGQ

SEQ ID NO: 88917 - DNA, 953 bp, Zea mays
  misc_feature: Ceres CLONE 1576399
  misc_feature: Encodes the peptide sequence at SEQ ID NO. 88918
  misc_feature (48)..(48): n is a, c, t, g, unknown, or other
  misc_feature (181)..(181): n is a, c, t, g, unknown, or other
  misc_feature (205)..(205): n is a, c, t, g, unknown, or other
gggggggggggggggggggggtcaaccccccctccacagaaagtaganttttttgtttccgagtgtgggtgtttttttttttttaaactggaactccccgcggtggcggccgctctagaatagtggatcccccgggctgcaggaattcgtctcacccctagaaaaagtccactcatctcancagctgaactgacactgaacatgngggtctcattgccgctggccagcaacgcctctgccttcttccctcggcctccgccctctgctgctagtctgccagcttcgaaacctccgccccgtcgcataaacccctcctcgcctcctccgcccgagcctgcctcctcatcgacttatacgcctccttctgttaactcgacgcactagcctcagccatttgtcgcatttcgacgctatggggtccacaacctccatctccttctcctcctcggcgatcgcgtcccgcggctgcgccagatccgaggctgccccccggccaggtggaatccgggtctgcggactccggagcgaggccctcacgtgtcactcgcttcggatctcgcaagcgcccgcgaggctgacggtggcgaggccgccgccgccggcggcaggcgaccaatgagcgcggcggcgggagaccctgcgaggttcgactacgaattcctcgtcatcattcgggcgcagggtcgtcgggggggtccacgggcccccacgcctggcaacgcccgttagaaaagaagggctttaaataacaagcaactaatttgcaggggaggatgtttgtgggggtgagggaaccttggtggttaaaccagaaaggcctgggggtcccccatccaaaaaagcgcctccctttacagggacaagccgggtcccaatttgcccgggaaaccctccatcgaaaagaaaacctcccattaagcgaaaagtccctttgtgggatccttaacaaggga

SEQ ID NO: 88918 - protein, 68 aa, Zea mays
  misc_feature: Ceres CLONE 1576399
MGSTTSISFSSSAIASRGCARSEAAPRPGGIRVCGLRSEALTCHSLRISQAPARLTVARPPPPAAGDQ

SEQ ID NO: 88919 - DNA, 865 bp, Zea mays
  misc_feature: Ceres CLONE 1576401
  misc_feature: Encodes the peptide sequence at SEQ ID NO. 88920
  misc_feature (478)..(478): n is a, c, t, g, unknown, or other
  misc_feature (479)..(479): n is a, c, t, g, unknown, or other
ctggagctccccgcggtggcggccgctctagaactagtggatcccccgggctgcaggaattcgtctcacccctagaaaaaatgccaactgtattcgcactcacggctagatctcgcttccctccacctccagatccaccccgaactctccgaaggccgcccccgccatggcagcgccgccccccaccactccccgtctcctctcgccgacgtccaaggaccttctcacagccgcctccttcacctcgccgccctcccccacctccgacgatcccgcctccccgctcgacgccttcgcctccgatcccgtcctctccgccttcctgtcgccgtccttctccccttctgtcttctcctccgccgcgctttcctcaggactcgctgcctcccgcgccgagcagctgcaggatgccatccgcctcctccgccgccatctccgcgtcgaggtgctgcgccgccaccccctcctcctctcccannctccttctctccgctcccgctccgcgtctctctcctcgctcccatcccacctcaacttttctcctctaactctctctcctttcctccactcttgggcccgggctcccatttggtactcctcgggttccctttccgcctcttggccaaggcgacctcctcctccatcccacccgttaggggctttcctcccgaacctgggctcctcccgggcccaattttgcgccccaggtagacctctccgggagacccccccccccttaaggaaaaaaccccccgggttaaaccctttcaaaaaatacccagaggagtaccctccccaaaaaatcgcccaaaaaccccctgttaaaagagggggggtccaaaaaacaaaaaaaaaaagggggtgt

SEQ ID NO: 88920 - protein, 233 aa, Zea mays
  misc_feature: Ceres CLONE 1576401
  misc_feature (104)..(104): Xaa is any aa, unknown, or other
  misc_feature (105)..(105): Xaa is any aa, unknown, or other
MAAPPPTTPRLLSPTSKDLLTAASFTSPPSPTSDDPASPLDAFASDPVLSAFLSPSFSPSVFSSAALSSGLAASRAEQLQDAIRLLRRHLRVEVLRRHPLLLSXXPSLRSRSASLSSLPSHLNFSPLTLSPFLHSWARAPIWYSSGSLSASWPRRPPPPSHPLGAFLPNLGSSRAQFCAPGRPLRETPPPLRKKPPGLNPFKKYPEEYPPQKIAQKPPVKRGGVQKTKKKRGC

SEQ ID NO: 88921 - DNA, 1132 bp, Zea mays
  misc_feature: Ceres CLONE 1576402
  misc_feature: Encodes the peptide sequence at SEQ ID NO. 88922
  misc_feature (62)..(62): n is a, c, t, g, unknown, or other
  misc_feature (64)..(64): n is a, c, t, g, unknown, or other
  misc_feature (1132)..(1132): n is a, c, t, g, unknown, or other
aagaagggtacccccacccctaaacccaaccacacacccaccacccctctaaccacccacancncccaaaaaactggaactccccacggtggcggccgctctagaatagtggatcccccgggctgcaggaattcgtctcacccctagaaaaatattaacgacatccactacgtcgcagactctgatagattaattcctgctggtgaaaccgaatttgccaaggatgcagtttttggctataaatcttccaatctcagacagtgggttgaagagaagaccaaaggacgggttttggagaaccaagtttcaacaatttccataactctcttgcgtaaacaaggaccaactgctgtttgtgagcatctctgtagcttggagaagggctctgtgtgcatcgtcaatgctgctagtgacagggacatggctgtctttgcttctggaatgatccaggctgaattgaaaggaaagggacccccccccacaactgcaagttttgtgagcgcaaggattgggatcaagccaaagccacctatctgtccaaatgaccttggcttaaaaagagctttaactggaggcctcataattgttggttcatatgttgccaacaactaacaaagcgggtatgatgagcttgcgcatccagatttcggacaattctctttcgaatccataatagggtggtctggtctagaatggtttttccagtgaaaatccaatgggagggtaccggagaatccgaagtaaattccacgaacggaaatctggtttggaaacctaaggggggaaagggcctttctttctgacccaatgcccaaaataaaaagaacaacaccctaagatttcttctgaccaggagccggcgccaaacttctattttaactgggataaaaacactctcttgaaaaaaagagcctgttacaaaaatatcaggttgttataaagtgcgggtctcccgccacctcagatgtggataaatctttgtgaacaaagggatttagtaacatgaaaacaccccattcatacaccactgtgccaagagggaggggaactgccccttcattgtagaagatttggcacacaagagggccgctggtaaaaccataaagtgtttcctaaacttatttggtgacan

SEQ ID NO: 88922 - protein, 32 aa, Zea mays
  misc_feature: Ceres CLONE 1576402
MQFLAINLPISDSGLKRRPKDGFWRTKFQQFP

SEQ ID NO: 88923 - DNA, 1151 bp, Zea mays
  misc_feature: Ceres CLONE 1576404
  misc_feature: Encodes the peptide sequence at SEQ ID NO. 88924
  misc_feature (6)..(6): n is a, c, t, g, unknown, or other
  misc_feature (12)..(12): n is a, c, t, g, unknown, or other
  misc_feature (60)..(60): n is a, c, t, g, unknown, or other
  misc_feature (61)..(61): n is a, c, t, g, unknown, or other
  misc_feature (657)..(657): n is a, c, t, g, unknown, or other
  misc_feature (857)..(857): n is a, c, t, g, unknown, or other
gggggncggttngtgtttgtgtggtttggttggggtgggtttgttgtgtggggggggggnnatgggtgtttgttcaagctggagctcaccgcggtggcggccgctctagactagtggatcccccgggctgcaggaattcgtctcacccctagaaaaatcgccatttcggatccgggcccgctcagcgcgcgggttcccgaacccggccggccggacgcgctcctcgccaccgccgccgccggccatgaagcgcgcgcgcagctccgaggtattcatcggcgtaagccggctgcgcgcacgcaggggcctggcgccgcttctcgcagcggcggctttcgcctacctactggtcgtgtccgtcaagctcaattacctcggcagcgctgggcccgcgcctgccgtcggccgcctggccaccaccggcgcgggcgagccagctgcgcgcgcgcgctcgagcgggggcgggggccgtgtcccggtacgggcgcatcaccggggaagatcctccgggggggacgaaagcccttcgaaggagccggcggaaagccggtgggggggcagcctggggggaaccttcccccggaagcctccaaagcccgcgatgggcggggcccaaaaaaccctggggggcgcctcccggggggccccccccccccnttggtgaaaggaaaaggcccctcccttctcgctttttcggaaccgggcgggaaaacagttttcggaaaaatataacaaatatacgggcccgttaccccgagaaagaaaaacaaagactctacacacctggggtgggggagaaggggggtatacccgcgggggtcccaaaaaaaatggtgtggcccccccgaggggggganttgtgatgtgagtctggggggagaatcatttcgggtgggagggcccccgcggggggtgaagaaaaacacaaaacggggggggggtttctctcctgtggggccccccagggtgagaggtgatccctcgtgggccccgaccccccccggggggtgttcgtgagacaaaatattttacccacaccggggtggtgtgtgtggggaacaaaaccaaacgggctggggtgaaaaaagggggggcgcggcggcacccccggaaaatatatcacacccttctcccaaaagaggcacgccccg

SEQ ID NO: 88924 - protein, 139 aa, Zea mays
  misc_feature: Ceres CLONE 1576404
  misc_feature (138)..(138): Xaa is any aa, unknown, or other
MKRARSSEVFIGVSRLRARRGLAPLLAAAAFAYLLVVSVKLNYLGSAGPAPAVGRLATTGAGEPAARARSSGGGGRVPVRAHHRGRSSGGDESPSKEPAESRWGGSLGGTFPRKPPKPAMGGAQKTLGGASRGAPPPXW

SEQ ID NO: 88925 - DNA, 843 bp, Zea mays
  misc_feature: Ceres CLONE 1576405
  misc_feature: Encodes the peptide sequence at SEQ ID NO. 88926
  misc_feature (673)..(673): n is a, c, t, g, unknown, or other
  misc_feature (703)..(703): n is a, c, t, g, unknown, or other
  misc_feature (705)..(705): n is a, c, t, g, unknown, or other
  misc_feature (790)..(790): n is a, c, t, g, unknown, or other
  misc_feature (793)..(793): n is a, c, t, g, unknown, or other
  misc_feature (810)..(810): n is a, c, t, g, unknown, or other
  misc_feature (818)..(818): n is a, c, t, g, unknown, or other
tggagctccccgcggtggcggccgctctggaactagtggatcccccgggctgcaggaattcgtctcgcccctagaaaagatccgctagcaggcgcgaggcgccccctgagacagaaactgaatcccgcctccaacctacgctcgaaacgcataccttcggtctcctccgtctgtccgtcgcccatccggccgcctcttctcccaccagccgccgctgccgcacgttagctcctactgcatcgtcgccggacctacgctacgcccccgtgcatcctcgccttggcaggcaggatctggccacctttcgccggcaacagtagggcgccgcataagtaaccgcctacacccgaggcaaggcggtaccccgtcgcccagcgtataagcgcggaaggagggcgcgcaatagcgccttttctaacactaatggcaacggcggcggcggatggcccccctgtggaaccgcagtctctgaagaagctgagcctccggtcgctcaagcggtccctggacctcttcgccccggcgcacgccctcctcttcacgcccgacgccgagagcaagcggattcgtactgggagcaaggcgagtgcggagtacggcgcggtgaaggacctcacgccggagcaagggcgcggagggcagagcaaaggtcctgcgccgccatcctcaacanctttggcattgccaggaacacatgatacananaatgctcacggagaacgctctaggaatgccattgtcccctgcaccacttatgctgccaaaaacacctgaatctaccatacgtggncanaaataccactctgtccncttcctgnatcatctgcacaatttttctacatc

SEQ ID NO: 88926 - protein, 116 aa, Zea mays
  misc_feature: Ceres CLONE 1576405
  misc_feature (84)..(84): Xaa is any aa, unknown, or other
  misc_feature (94)..(94): Xaa is any aa, unknown, or other
MATAAADGPPVEPQSLKKLSLRSLKRSLDLFAPAHALLFTPDAESKRIRTGSKASAEYGAVKDLTPEQGRGGQSKGPAPPSSTXLALPGTHDTXNAHGERSRNAIVPCTTYAAKNT

SEQ ID NO: 88927 - DNA, 963 bp, Zea mays
  misc_feature: Ceres CLONE 1576407
  misc_feature: Translation starting site: 468
  misc_feature: Pfam Name: zf-ZPR1 Pfam Description: ZPR1 zinc-finger domain
  misc_feature (479)..(479): n is a, c, t, g, unknown, or other
  misc_feature (858)..(858): n is a, c, t, g, unknown, or other
  misc_feature (876)..(876): n is a, c, t, g, unknown, or other
  misc_feature (945)..(945): n is a, c, t, g, unknown, or other
tggagctccccgcggtggcggccgctctagaactagtggatcccccgggctgcaggaattcgtctcacccctagaaaaagaaccagctggcgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataaggcaatctgaaaacattggccgccaaacctccagagcgactcccgcgagccgtgaccaccatagctaaatcaacgcaccagaagctttcacggagctgtctcgtccacgagtgttccagctgactcctattccctgcgtcaatggcgagctctggcaatgaagggcgtngtggtggtggaccttggctccgcggcggagtcggtggctgctgacgaggaggcgcacgccacgcctctccacgagattgagtccctttgcatgcgctgcggcgagaacggcatcacgaggcttttgctgacgttgatcccgcacttccgaggaggtggttctgatggccttcgagtgcccacattgtggtgagaggaacaacgagattcagtttgctggacaactccaacccaagggatgctgctacagctttggagttccgtttggggcagagtgagatgctgaatcgtcaggtcgtgaagtctgattcagcgactatcaagattccagagctcgactttgagaccctccagaagctcacgtgaacactttctactgntggaaggatatttatgcnagctgtggatgagctgcagggctctcagatgacgggaaaaaagtgatcctcaaaggccgaagctatcanccattttttacggaatgg

SEQ ID NO: 88928 - DNA, 915 bp, Zea mays
  misc_feature: Ceres CLONE 1576410
  misc_feature: Encodes the peptide sequence at SEQ ID NO. 88929
tggagctccccgcggtggcggccgctctagaactagtggatcccccgggctgcaggaattcgtctcacccctagaaaaactcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttctcaacaacctcggtaccatcgccaggtccgggacgaagggagttcatggaaagcccttgctgccggcgctgatgtgtcccatgatggcccaggtcggcgtcggtttctactctgcctacctcgtcgccgatagagttgtcgtgacccccaagccccaaccatgacgagcagtaccttgtggggagtcccaaggcgggcggggccgttcactggtacccctgaacaccctcggggaagccccttgggcaggggcccaaaaaaaaccccggttccctaagggcaaatcccctgggaaacccttgggggggctccccccccaggaatctggtcaaaaaacccccctgggatttttagggtcaccccccttcccggggggccgggaaaaaaccccgcgaaggggaatttctttccccccaaacccggggaaaaaaaaaaaattttcttgaaaagaaaaaggggggaagatttttttttggggggggaaaagaaaataggaaaaaaagaatacccgg

SEQ ID NO: 88929 - protein, 145 aa, Zea mays
  misc_feature: Ceres CLONE 1576410
MASETETFAFQAEINQLLSLIINTFYSNKEIFLRELISNSSDALDKIRFESLTDKSKLDAQPELFIHLVPDKATNTLSIIDSGIGMTKSDLLNNLGTIARSGTKGVHGKPLLPALMCPMMAQVGVGFYSAYLVADRVVVTPKPQP

SEQ ID NO: 88930 - DNA, 806 bp, Zea mays
  misc_feature: Ceres CLONE 1576411
  misc_feature: Translation starting site: 370
  misc_feature (663)..(663): n is a, c, t, g, unknown, or other
tggagctccccgcggtggcggccgctctagaactagtggatcccccgggctgcaggaattcgtctcacccctagaaaaagggccagtcgtcgacggcgagccgtacgtatattattacccccaggcgaaacccaaagagaacccgtaccaacccaaacaaaaccacacaccacctcctcgccggctcgtcatcgacatcgccatcgccatcgccatcgtttcattgcgagtctccgtttcatctcgccccctcacccccacacacactggaatccccgcgtctgaatccggcgccccccgccccgatccgcgccgaatcgccgccgctcggggtggaaccctagcccgatctcgatccgtttctccgcgatgggcgccggccgtgtctgtcgcggcggcccctcctccgtctcccccgccgcagggcggccgttctcgacgctcgccgcgtcgtcctccgcctccccttcctcggctccttcagagacggcgtccacgtcggtcaccaagacggtgaacggctcccaccacttcaaaatcgcgggctactctctctccaagggaatcgggggtggggaagttcatcgcttccgagtccttcaacgtggggggattcgactgggcgatctacttctaccccgacggggaaagagcgcgaggacngcgctgcctacgtctcgctcttcatagccctcgccagcgaggggtaccgatgtgcgcgcgctgttcgagctcacgctcgtcgaccagagcggcaaggttcaggataaggtgcatacccaccttcgggaggtcgctcgaaagcg

SEQ ID NO: 88931 - DNA, 959 bp, Zea mays
  misc_feature: Ceres CLONE 1576412
  misc_feature: Encodes the peptide sequence at SEQ ID NO. 88932
  misc_feature (746)..(746): n is a, c, t, g, unknown, or other
  misc_feature (816)..(816): n is a, c, t, g, unknown, or other
ctggagctccccgcggtggcggccgctctagaactagtggatcccccgggctgcaggaattcgtctcacccctagaaaaaacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggaggacgacgatggccggcgcgaccgtgaccgtggaggaggtgaggagaggcccagcggcgccaccggccccgccaccgtgctggcgatcggcaccgccacgcccgccaactgcgtgtaccaggccgactacccggactactacttccggatcaccaagagcgagcacctcaccgacctcaaggagaaattcaagaggatgtgcgacaagtcgatgatccggaagcgttacatgcacctgacggaggagttcctggcggagaacccgagcatgtgcgcgtacatggcgccgtcgctggacgcgcggcaggactggtggttcggtggaggtgccgaaactggggaaggcggcggcgcataatgcgatcaaggagtgggggcagccaaagtcgcggatcacgcacctggtgttctgcaccacgtaccggggatgacatngcgggcgccgactaccactgaccaaggcgctgggcctgccgccctccgtgaaccgcctatgatgtaccancatgggtgcttcccggcagcacggtgctgcgcgtggccaaggactcacggagacaactcgaccgcgggtgctgttggttgctcccaattacggccgtacgttcggggcccctcgatccacctgactcgtcctggcaaggtgtc

SEQ ID NO: 88932 - protein, 53 aa, Zea mays
  misc_feature: Ceres CLONE 1576412
  misc_feature: SWISSPROT Homolog: EC 2.3.1.74 Naringenin-chalcone synthase
MCDKSMIRKRYMHLTEEFLAENPSMCAYMAPSLDARQDWWFGGGAETGEGGGA

SEQ ID NO: 88933 - DNA, 850 bp, Zea mays
  misc_feature: Ceres CLONE 1576413
ggccgctctagaactagtggatcccccgggctgcaggaattcgtctcacccctagaaaaaaccttctccaccagctggctgcacccctcctgcccctctgcgctggcgggacgagcgccccgagcgagctgggccgctcgcggaggaggagtcgaggctgacctaccccgcgtccgggggtgacgagcggacacttattcggcatgccgtgcgcggaatgcccgtggaaggaggggagagagggagggcgcatgctcggctgatctgatctgagcccgcgtggttctcggtctgcggtgcggcggctgaggtctcgccagcgcgtatggctcatcggcggctcatccttggtacagctcgtacaatgcgccggggctgcgctgcagacgtctgctggaggcggcgcacgtgtcgttgcctcgaggaccggtactcgctgggcccgcctctggaggtggggccagtgctgcctgatccggtcctgctcctacctggttcaacggcgaggcgctcggcctgctaagtccatcgccaagggccgggtcgttgtccccctactacgtgcgcagggtcaagcttggagaatcacgtcttgggaagcctggggggccttccccaacttggtggggccttcagggcctggtacatggaaccgcaacttctgttgccccgcgttttgggtagccctgacccggagggaaaaggtctttcccccgccttgaaggatgttgtgggtgcttccccctaaccgggtggggcggtcttcgcttttttcgggaacctttatggttggttgcaccccgcaaatgtcccccccatggggggactgtggctccggggggtccaacag

SEQ ID NO: 88934 - DNA, 834 bp, Zea mays
  misc_feature: Ceres CLONE 1576418
  misc_feature: Encodes the peptide sequence at SEQ ID NO. 88935
  misc_feature (664)..(664): n is a, c, t, g, unknown, or other
  misc_feature (692)..(692): n is a, c, t, g, unknown, or other
ggagctccccgcggtggcggccgctctagaactagtggatcccccgggctgcaggaattcgtctcacccctagaaaaactctcctctcgctctcgctctcccgcgcctgcaccgatcagttgccatatattcctccaccctccctatctcaagcacctaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcggtgctgatggtggtggccgcgcgcgcgcggttcgtggtggagaagagcagcgtgcgggtgctggcgcccgagcacatccggggccaccacgacgccgccatcggcaacttcggcgtgcccgactacggcggcacgctcaccggcgtcgtcatctacccggacaccaagcccacggggtgcgacgacttcgacgccaagttcaaggccaagtcccgcccgcccgtcatcctcctgctcgaccgcggagaatgctacttcgcgctcaaggcgtgggaacgcgcancgcgcgggcgcggcggcggtgctgatcnccgacagcgtggacgagcagctgctgacgatggacagccccgaagggcgcccccgggcaccggagtaactcgaacaggatcaacaatcccgtccgggcctggggaacccgcgcggttcgggggagtcccttaaaaaagaaga

SEQ ID NO: 88935 - protein, 162 aa, Zea mays
  misc_feature: Ceres CLONE 1576418
  misc_feature (110)..(110): Xaa is any aa, unknown, or other
  misc_feature (119)..(119): Xaa is any aa, unknown, or other
MAAGRAPWLAAGLVAVLMVVAARARFVVEKSSVRVLAPEHIRGHHDAAIGNFGVPDYGGTLTGVVIYPDTKPTGCDDFDAKFKAKSRPPVILLLDRGECYFALKAWERAXRGRGGGADXRQRGRAAADDGQPRRAPPGTGVTRTGSTIPSGPGEPARFGGVP

SEQ ID NO: 88936 - DNA, 880 bp, Zea mays
  misc_feature: Ceres CLONE 1576419
  misc_feature: Encodes the peptide sequence at SEQ ID NO. 88937
  misc_feature (396)..(396): n is a, c, t, g, unknown, or other
  misc_feature (399)..(399): n is a, c, t, g, unknown, or other
  misc_feature (880)..(880): n is a, c, t, g, unknown, or other
ggagctccccgcggtggcggccgctctagaactagtggatcccccgggctgcaggaattcgtctcacccctagaaaaaattactgacaggcgccagagagagagagagagagaccacaactcctctcgcctcgcctcgcctcgcctcccccggggaagaagaggaggagagggagctgagcagcagccggccgacgcgggaatgctcgtcggcggcgggcgggacgacgaggaggtgctccggaagctcaagagcatggacgtggacaagatggagaacggcggcggcggcggtgaggcggagagcccgcgccccgccgtcaagtaccacggctggaaggccatgcccttcatcatcgggaacgagacgttcgagaagctggggacgctgggcacntcngccaacctgctggtgtacctgacgcaggtgttccacatgcggagcgtggacgcggccacgctgctcaacgggctcaacggcaccaccagcctcgcccccatcgtcggcgccttcctctccgacgcctacctcggccgctacctcgcgctcgccatcgcctccatcgcctccctcatcgggatgttcctgctgacgcttacggccggcgcggacagccttcacccgccggagtgcagcgtggggggagacctgccgagaaggcaacgtcttaccagtttccgggtgctcttcgtcgcctttcgcgttcccggggggcggggctcgggcgggggatccgccccctggcagcctggccccttcgggggccgaaccagtttcgaaccccctacaccggagttccggggaaggcgcggggaattaaccgggctttcttgttacacgggggagcctatctttcgcggtttctcggggcggggccccn

SEQ ID NO: 88937 - protein, 226 aa, Zea mays
  misc_feature: Ceres CLONE 1576419
MLVGGGRDDEEVLRKLKSMDVDKMENGGGGGEAESPRPAVKYHGWKAMPFIIGNETFEKLGTLGTSANLLVYLTQVFHMRSVDAATLLNGLNGTTSLAPIVGAFLSDAYLGRYLALAIASIASLIGMFLLTLTAGADSLHPPECSVGGDLPRRQRLTSFRVLFVAFRVPGGRGSGGGSAPWQPGPFGGRTSFEPPTPEFRGRRGELTGLSCYTGEPIFRGFSGRGP

SEQ ID NO: 88938 - DNA, 858 bp, Zea mays
  misc_feature: Ceres CLONE 1576427
  misc_feature: Encodes the peptide sequence at SEQ ID NO. 88939
ggagctccccgcggtggcggccgctctagaactagtggatcccccgggctgcaggaattcgtctcacccctagaaaaagtcggtcgtcactagtcctcgctcatagcaggcgccaggcggcagtgactcatcactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgcctcccagctgctcctcgtgctcatctccctccacctcgccgcggcgcggcggaggcggcccaggaagggcgtcgcgcacgcgcacgcgcccgcgccggcgggggcgccgccgctgtccccgtccaccatccctgccgtgttccaggagatccaggaggtggccgtccacgtcggctcgctccgccactacctcgagacggggcactcgttcctcaaggacggcggcggcgaccgcgacagctaaggggagtccctggcgcacgggtcgcagcgcgtccacatcaaggctggccagggccatcccatggttcgcggcgggcttccaacaccccttttcggggggcctgggggccccgaaggtgtctccacctttcggctggcgcgccacgtgggaaccgcccctgccgcggaacttgggaagagaagcccaccggcgcggtgtttcgccccccgagaagaaa

SEQ ID NO: 88939 - protein, 116 aa, Zea mays
  misc_feature: Ceres CLONE 1576427
MSPPPPPPLLRNELSRRTAVLGLRLWVLVGIAVGAASQLLLVLISLHLAAARRRRPRKGVAHAHAPAPAGAPPLSPSTIPAVFQEIQEVAVHVGSLRHYLETGHSFLKDGGGDRDS

SEQ ID NO: 88940 - DNA, 912 bp, Zea mays
  misc_feature: Ceres CLONE 1576428
  misc_feature: Encodes the peptide sequence at SEQ ID NO. 88941
  misc_feature (399)..(399): n is a, c, t, g, unknown, or other
ctcaccgcggtggcggccgctctggtgctgtcggatctccgggatgctggaattcgtggcgggcttagaacaaagggtcttgaactttctccttagcattctgtctggtggggtcgtggtctttggtattgtcggcgccgtggtagggctctgcaactttcaccccgtcaagagggcctgatcggaatccatcggatcgatcaaacacggctgtgtactgacctgtgtctgtgctgtctgtatagactggtgaggctatgtcgactgtgtgttaagtgattgttgagaatgatgagacgtatatctatctctaagaaatggagttggagatacactttactcaacaaaagaatacacctctgcagatgagtcatgagtggatagatgcgcacccccccncgggtggttcgagtgtcacaacgaatctctcaaagcgccccgccgatgctttctggggtgtgtaacggaaactatgtgcttcacattcaggggacggtcgcggttcgcagaatgggtactcataggggggacttccctcctctaatgagtcatgaaggtcgtcgtcgtccccgagttggggattgtctcagcagacagggatttcccccagctgcattttgtaaggtgcaggaggggggggggcacttgcttctggtacttgtgaggatacgaaaggctgtggattggatatggggactgttgcgctaatttgtgtgaactttcatggggtccgggtaatgatgacttctccatgggaaaggccttttttgggtcttgggggaaaattgtggttggggggattcttcggaagatgctccgaaacttgtgtttcttggaaaattgggtgccgtgtgaaaaccctctgggctaggctccagtttgaaaagggttatggctgaagacctctgcaga

SEQ ID NO: 88941 - protein, 45 aa, Zea mays
  misc_feature: Ceres CLONE 1576428
MLEFVAGLEQRVLNFLLSILSGGVVVFGIVGAVVGLCNFHPVKRA

SEQ ID NO: 88942 - DNA, 993 bp, Zea mays
  misc_feature: Ceres CLONE 1576430
  misc_feature: Encodes the peptide sequence at SEQ ID NO. 88943
  misc_feature (56)..(56): n is a, c, t, g, unknown, or other
  misc_feature (64)..(64): n is a, c, t, g, unknown, or other
ttttttttttgtttttttttttggggaaagggcggcgttcctacaatttagttttngagaaggntaacaggtttttttttttaaagctggagctcaccgcggtggcggccgctctagaactagtggatcccccgggctgcaggaattcgtctcacccctagaaaaaacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacaccggtgcttggctggatcgtgctcggcgtcctcaagagggacaacctcgtctacaagctcgtctcggacgctgagatcccggagccgccgctgttcacggccacccacacatggcaaccgatccgggagcagagcgtgcgcgtgacggatccgaggctgtcgccggcggagcgcgtgcaagaggcccgtcgcctgcgtcccagctgctgcccaggcccaacctgggagccggacggcgggggttttaggccgctgggacgggtgcggggaacttcccacaggggcgttacagaattcaaggaacaggggcttacccccctaacccatggggggggcggccgggcgaaattccctggggccaggcccgtggggaaggaaaatggttctcagggggccccaggacccctggaaaacaaggggggcctttcctttctcatccaggcctgtgcgaaaccctcggccgggaaccgttgccttgtccggaccagaggccccaaaggaaacctcccaccccccgcctaaaataacccaatgcaaagggaggggccgccccgcctttgtcccccgcccacatggggaaaccgggaagagtggcctggagttcccacccccgtttccaaaaga

SEQ ID NO: 88943 - protein, 224 aa, Zea mays
  misc_feature: Ceres CLONE 1576430
MGFFIPPPKVYKPAAEVDLGPDSDEHYISPNVKAPRVAGFLVKMLAWVLETPVLGWIVLGVLKRDNLVYKLVSDAEIPEPPLFTATHTWQPIREQSVRVTDPRLSPAERVQEARRLRPSCCPGPTWEPDGGGFRPLGRVRGTSHRGVTEFKEQGLTPLTHGGGGRAKFPGARPVGKENGSQGAPGPLENKGGLSFLIQACAKPSAGNRCLVRTRGPKGNLPPPA

SEQ ID NO: 88944 - DNA, 940 bp, Zea mays
  misc_feature: Ceres CLONE 1576431
  misc_feature: Translation starting site: 208
ctggagctccccgcggtggcggccgctctagaatagtggatcccccgggctgcaggaattcgtctcacccctagaaaaaattggtttcgccaaaaacctcaccggctccattcgaccattccatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgacatggaagctggggagtttgaggaagtgctagcctcaggcggcgaaggtgaggggcagtacgctgcggtggagccgccagagaagccaaggtctacgttggaaacttccctacgacgtcgacagcgaggaactcgcgcagatcttcgaccaggccggcttcttcgaagtcgcccaagttatctacaacagaaaaactggccaaaaaccggggggtttggctttgttaccttgaacacggttgaggaaacctaaaaagcccttgaaaagttcaaccccctaggatataaccggggagggttcgaaatggaaacagggacctttctagggccccccccggggaaaaacccccaaaaaaattttgccccatttttcaaaacttttttgggaaacttccccgggaaatgtggaacccccgggcgggggggaattttcccaaacaaaggaaaaattttttaaccaaagggttcccaaaaaaaaaaaagggggccccaaaaaaaacggttttttaaacttgggggaaaaaaaa

SEQ ID NO: 88945 - DNA, 745 bp, Zea mays
  misc_feature: Ceres CLONE 1576432
  misc_feature (126)..(126): n is a, c, t, g, unknown, or other
  misc_feature (137)..(137): n is a, c, t, g, unknown, or other
  misc_feature (577)..(577): n is a, c, t, g, unknown, or other
  misc_feature (578)..(578): n is a, c, t, g, unknown, or other
  misc_feature (593)..(593): n is a, c, t, g, unknown, or other
  misc_feature (681)..(681): n is a, c, t, g, unknown, or other
ctggagctccccgcggtggcggccgctctagaactagtggatcccccgggctgcaggaattcgtctcacccctagaaaaaatgcaacgccttccacacttgaagcagccaagctaagtgaggtgangcttagccatngccgaacggcttcctctgcccaccgctcactcctcctctgcctctgcctggctctgctctccaacccggtcgccgcctcgccctcgccccgcggcctccgcttctccgccaagacatcgcggcggtgaggccgcgctgccgcgacacggcagcagggcgtcgtcgtcgtccaagacaactttcttccaagggtcaaacgccccctccgcccccccaggggaaaattcggggccttggtccaggtggtggtttttgaattttttccctttaaagcttacaaaggcccccgttacccgggggtaaatttccccccccccctggtcttttttggggttccaaaacacccccccggggtttttcctcccccggtttttttaaagggggggcgccccaaaaaggccccccgcgccccccaaaaaaaaaacccaccccctcctttnncggggggggggtttntgggggcgccccaaaaaatttttttgtggggggggacccaccccggggggcccccccccccccccccgggggggggggggtttttttnttttttccctccccaaaaaggaagaaaaccccccccccctcgtggggggggggcgctcctccca

SEQ ID NO: 88946 - DNA, 956 bp, Zea mays
  misc_feature: Ceres CLONE 1576436
  misc_feature: Translation starting site: 295
  misc_feature: Pfam Name: Gal-bind_lectin Pfam Description: Galactoside-binding lectin
atagctggagctccccgcggtggcggccgctctagaactagtggatcccccgggctgcaggaattcgtctcacccctagaaaaagcctgcgtggccgcgtctgtacctgtacggccaccaccatttccatctccgattcccgcgaccccccacccagccccaggcgcccgggctagatccggcccacgcgtctacccgtcccctccggctccccttctccctaatcgccgtcgccgggggtgcaggcacagcggctgcttccgctcccgctcccgaggggggaggcggcaggcaatggcgcggcgggtgcggccgtcgcacctggtgctggcgctggcggcggcctacctcctcctcatctccctcaagttccgccgcgtgctggacctggccgccaccgacctcgcggacgaccctgccgccgccgccgccttctcctctccgtcctccgccgaccacctgcccccgcccgggtccgcttccgccacctcctcctcctcctcgcccccgttcccggtccgccccttctggcaccgctacgaccgtgtgtccctccccgacctcgcgtcccgcaaccgctccgcgctcgaccgcatggccgacgacgcctgggcgctcggcctcaccgcctgggaggacgccgccgccttcgcgggggacccctgggcgctgctcgccgccgccacctcccgcgcctccgacgccgcctagtgcccctccgcggtctcccagcgcgcgcggggcccgggtagtcttcctcccctgcgggctcgccgcgagctcgtccgtcaccgtcgtcagcacgccgcgcgcctcgcacaggtagtacgtgccgcagctcgcgcgaatgcgcagggggacggcaccgtcatggtgtcccagtcatggtcaagctcaggggctgggcgccgtctacggggaggaaccaccagaatactcactcaaccaggaagagc

SEQ ID NO: 88947 - DNA, 849 bp, Zea mays
  misc_feature: Ceres CLONE 1576439
  misc_feature: Translation starting site: 119
  misc_feature (518)..(518): n is a, c, t, g, unknown, or other
tggagctccccgcggtggcggccgctctagaactagtggatcccccgggctgcaggaattcgtctcacccctagaaaaagctccacgcctagggtttctctgcctcgccggggaagcgatgcagccgctgcaccaaccgccgatgaacgggcaacacggcccgcctcctccgcagggatccggggttcccacgccttcgcagcagcaggcgccacctccgtcgtactaccagcagcagcagcagcaggcgccaccgcctcagtactaccagcagggtcccccacagccgtgggcgcagcagcaacagtacgctccaccgccgccgcagtacccgcctcagatgcagcagtacgctccaccaccgcagcagtacgctcctccgccgccgcagcagtacgcccctccgccgcagcagcagtccgctactccgccgccgcagtacgctactccgccgccgcagtacgcgcagccgccgcagtacgcgcagccaccgcagtatgggacaacgcggggaagcngtgaggtcagaaccctgtggattggaggtctcagtactggatggacgagaactatctcactacacggccttccgcctgtggcccaacaaaaatgcctctggtgaaattttccggaacaagcgactgggccctcaaaaggttaggtttttaatggattttacccccaaagccgctgcaaaaaaaacccggaaaaacttcaagggccaaatgaggcccaaatttggaaaggtttttaacctaaattggggcttcccccaccccgggggaaaaacgggggaaaaaaaaggttctcaacccccaaaattttgtgggtggattttcgcccccctag

SEQ ID NO: 88948 - DNA, 1083 bp, Zea mays
  misc_feature: Ceres CLONE 1576440
  misc_feature: Encodes the peptide sequence at SEQ ID NO. 88949
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (61)..(61): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (802)..(802): n is a, c, t, g, unknown, or other
  misc_feature (870)..(870): n is a, c, t, g, unknown, or other
nnnnnnnnnnnnncctccccctgccaatctacagcggaaggagaggggaggggaagaggcncggggggtgntnntnnaaaaactggagctccccgcggtggcggccgctctagaactagtggatcccccgggctgcaggaattcgtctcacccctagaaaaagatgagcccgacccgccatgctgctgcccgtctgctccaccgcccccagctgctaccccctctgcccggtgacggacgcccacctcatcgcgctggcggcgcgaagggtggacgtcggtgccgctctcacgtgctacgccgactcgctcgtcgatctcgtgggcgaacgcccgctgctcgccgactcctccgtactctgcccctacatcggcgcgccggactacatcgctcgagccttccgggcccccgcctccgagcttcgacggctcccgagcggccaccccagccctgggctatgttgcacggggcaccgaccatcccgctggcaagccagtcgcggaacctggggcgccacctggcagttgggcccaataggcctccccagcagatcgcacccacccgaccttggccccgtgatccgaacccccccaaggggtccccccactccacgggtaagcccagtgctcgaaccaccggaacacgcaagggccccgaaaaggaaaacaatcgccggtagggacccccagggcaatcccgtcccgcgaaataatatagggtgccaccagggccaaaaagagacacaaggggtgtctccttaaggcacaaagcagttcgggcgaacagggtaaattgaccctcncttacagaacccaggacagagaccctctatagcggaaaaacaacccccctctgaaaagggcttgggtncaccaaaccggtataccgaaaaatagcgaaccttttgggctggaacttttgctgaagaggaacacaacccgggggccaggccccaccccgccaaatgggggagggggcgataacaaagggtccgcctcgggtcccaaggggccccggttaaaacaagaaggggccccccccgaaaaggggccttaccgggaatgctttccgcgggcggctctc

SEQ ID NO: 88949 - protein, 193 aa, Zea mays
  misc_feature: Ceres CLONE 1576440
MLLPVCSTAPSCYPLCPVTDAHLIALAARRVDVGAALTCYADSLVDLVGERPLLADSSVLCPYIGAPDYIARAFRAPASELRRLPSGHPSPGLCCTGHRPSRWQASRGTWGATWQLGPIGLPSRSHPPDLGPVIRTPPRGPPTPRVSPVLEPPEHARAPKRKTIAGRDPQGNPVPRNNIGCHQGQKETQGVSP

SEQ ID NO: 88950 - DNA, 976 bp, Zea mays
  misc_feature: Ceres CLONE 1576441
  misc_feature: Encodes the peptide sequence at SEQ ID NO. 88951
  misc_feature (843)..(843): n is a, c, t, g, unknown, or other
  misc_feature (844)..(844): n is a, c, t, g, unknown, or other
  misc_feature (889)..(889): n is a, c, t, g, unknown, or other
  misc_feature (949)..(949): n is a, c, t, g, unknown, or other
  misc_feature (964)..(964): n is a, c, t, g, unknown, or other
aaagctggagctccccgcggtggcggccgctctagaactagtggatcccccgggctgcaggaattcgtctcacccctagaaaaactctcctcccaaactgcggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgctgccgtggttcaagacgggcgtcatcccgcccgcgggcacctacaactactgggccgactcctacacactcttcgtcttcaacatggcgctcatgggcttcgccgagcaccgccgcctccaggactggtacaacccgggctccatgggcaagcagtacttcctcggcctcgagaagttcctcgccggctccggcgacccgtccctacccggcgagccccctcttcaacccgctcggcttcggcaagaccgaggaagagatgaatgagctcnnagctcaggagattcagaacggcaggctcgccatgctcgccatccntcggtacttcatccaggggctcgtcacccgcgttgggccggtccaaaacctggtcgacanctcgccgaacccgtnaacaacacgtgg

SEQ ID NO: 88951 - protein, 213 aa, Zea mays
  misc_feature: Ceres CLONE 1576441
  misc_feature (55)..(205): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPPAGTYNYWADSYTLFVFNMALMGFAEHRRLQDWYNPGSMGKQYFLGLEKFLAGSGDPSLPGEPPLQPARLRQDRGRDE

SEQ ID NO: 88952 - DNA, 827 bp, Zea mays
  misc_feature: Ceres CLONE 1576443
  misc_feature: Encodes the peptide sequence at SEQ ID NO. 88953
  misc_feature (522)..(522): n is a, c, t, g, unknown, or other
  misc_feature (558)..(558): n is a, c, t, g, unknown, or other
gcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacngcggtggcggcggctacggtggcggcggcggctacngtggtggtggcggcggctaccgcggtggcaaccgtggcggcggctacggcaactccgacgggaactggaggaactgagcggtggggcccgcgcgggccagttatcctgttcgctaccgtgaatgttaccctagtccagagggtttatcttcgttcgtgtccgtgtttgttgttggccaatcggtgttttttgattgcaaggtcgctccgtggtcagttgttaagtggctgggttcatccctcggttttcagcagaccccttgcatcaat

SEQ ID NO: 88953 - protein, 155 aa, Zea mays
  misc_feature: Ceres CLONE 1576443
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (119)..(119): Xaa is any aa, unknown, or other
  misc_feature (131)..(131): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYXGGGGYGGGGGYXGGGGGYRGGNRGGGYGNSDGNWRN

SEQ ID NO: 88954 - DNA, 828 bp, Zea mays
  misc_feature: Ceres CLONE 1576447
  misc_feature: Translation starting site: 188
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctgggggtgattgctggcctcaatgtgctgcgtatcatcaatgagccaaccgctgctgctattgcctatggtcttgacaagaaggcaccaagcgtcggttgagaagaatgtcctcatctttgaccctgggaggggggacctttcgatc

SEQ ID NO: 88955 - DNA, 963 bp, Zea mays
  misc_feature: Ceres CLONE 1576450
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (75)..(75): n is a, c, t, g, unknown, or other
tgttggtgggttttttagggnnnnggnnnnggggctgcgggtggctccctaataatttagggnntnnnggttggnttttgtcaaagctggagctcccctcggtggcggccgctctagactagtggatcccccgggctgcaggaattcgtctcacccctagaaaaattcctcacacccacacaaaccgcacctcatccctgttgacccgacggtggcgctcatctcctccccgacggtggcgctcatcttccccccgacagttctccccatcgacctgctggcttcccttcgtcttccccgacactgatcctcaccactcatgtctgctgaagttgccggacgaaacccttatttcctctcatgctacttctggttcatatactgcataaaattccgagatttcacttgatacaagtggaacactacgagttttgtgcaaatacttcctaccatgtgaatcagttgtagctggtgaattttgcccagactcaagtccctctcatctggggttcagaaaaacatcctggcgggttgattgccttggtgctccctgtttccctttggagtcttgggcaaaacaaaagtttttcttctcagcaatcaatttggtgggccctaccgaaacctctttttctggtgactttggaacccaaacctgctcattttttggggcccccgggccaaattccttggccaaaaaacatcccccctttcaaaaagaaccttgttccctaaaagggctgggaatttgccccctggccccctccggcttgggcggctgccaatccggccccttgagaactttcccaagaatttttcctctctgggcaaaaccagtttgtttatcccaacggaaacctcctttcccggggaaaattggaacaaaaactccccctttttggggccccgggcgaaattttttgccaaccctcccctttctaaaaaaacttggtgccagagagt

SEQ ID NO: 88956 - DNA, 781 bp, Zea mays
  misc_feature: Ceres CLONE 1576459
  misc_feature: Translation starting site: 381
ctggagctccccgcggtggcggccgctctagaactagtggatcccccgggctgcaggaattcgtctcacccctagaaaaaagggcaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatggggggagggtgatctcgtggacccaccgccagacagcttcccggacgccgtggaggacgacagcgatgacgacgttgaggacatcgaagagctggagcgccgcatgtggcgcgaccgcatgaagctgaagcggctcagggagctgcagcagagccgcggcaaggatcccatggctagcggtggggggcctggccgaacgctcatcctaagccatgcagtcgcaggagcatgcccggcgcaagagatgtcgcgcg

SEQ ID NO: 88957 - DNA, 784 bp, Zea mays
  misc_feature: Ceres CLONE 1576461
  misc_feature: Encodes the peptide sequence at SEQ ID NO. 88958
  misc_feature (678)..(678): n is a, c, t, g, unknown, or other
  misc_feature (679)..(679): n is a, c, t, g, unknown, or other
tccccgcggtggcggccgctctagaactagtggatcccccgggctgcaggaattcgtctcacccctagaaaaaagctctactcaaagagcgctctaccagtacaactacaaccacactaaaacccaaacaaaaaaaaggaagcaggtgctgccgatatatcgattgatcgatcatggcggcggccgtggccaatatcggcatggagtggctccaagaccctctgagctgggtgttcctgggcacggtgtgcttggtggtcctgcagcagctgcgacgtcggcggggcaaagcgccgcttccgcctgggccgaagccgctgccgatcgtaggcaacatggggatgatggaccagctgacgcaccgcgggctggcggcgctggcggagacgtacggcgggctgctgcacctccggctggggcggctgcacgcgttcgcggtgtcgacgcccgagtacgcgcgcgaggtgctgcaggcgcaggacggcgcgttctcgaaccggcctgcgaccgcggccatcgcgtacctgacgtacgaccgcgcggacatggcgttcgcgcactacgggcccttctggcggcagatgcgcaagctgtgcgtgatgaagctgttcagccggcggcgcgccgagacgtgggcggccgtgcgcgacgagtgcgcggcgctggtccgggccgtannccgtgggcggggcgggggcaggggcgaggccgtgaacctgggcgagctcatcttcagcctgacgaagaacgtgacgttccgcgcggcgttcggcacccgcgacgg

SEQ ID NO: 88958 - protein, 203 aa, Zea mays
  misc_feature: Ceres CLONE 1576461
  misc_feature: SWISSPROT Homolog: EC 1.14.13.88 Flavonoid 3',5'-hydroxylase
  misc_feature (169)..(169): Xaa is any aa, unknown, or other
MAAAVANIGMEWLQDPLSWVFLGTVCLVVLQQLRRRRGKAPLPPGPKPLPIVGNMGMMDQLTHRGLAALAETYGGLLHLRLGRLHAFAVSTPEYAREVLQAQDGAFSNRPATAAIAYLTYDRADMAFAHYGPFWRQMRKLCVMKLFSRRRAETWAAVRDECAALVRAVXRGRGGGRGEAVNLGELIFSLTKNVTFRAAFGTRD

SEQ ID NO: 88959 - DNA, 809 bp, Zea mays
  misc_feature: Ceres CLONE 1576462
cgctctagactagtggatcccccgggctgcaggaattcgtctcacccctagaaaaagagcaccctctatccgttcttcagcaggcgcctcccacgtctgcagtccgactctccgagtcactccccctcccccgccccaacccgtcgcaatggccggcgtctccgcagacgcgaggccctcgatgcctccccgactcgccctccgtgcccacctcttctcctccgcctctccgctcccaatgcgcgcgctccccttactccgcagccgcttccgctccttgaccacggcctacgctgtcgaggacgacacggacctctggacccctgcacccgtctccgccatcagtgctgcgaccgacgacggctccttctccccccccgccgtcgacctatctgacgcacacggacctcgtggactcgtacacgaacccgggccaatacctcctgatccgcgtacccggcgaggagctcaagccggcgtacatggtcatctcctcgccgcctaaagcggggccccggttcgaattcctcgtctaaagcgtgccgggagctaccgcggggcgggctctgcgacctccaaaacggggatgttgtggagcctcgcggccgtcacgtggaaggggttccccctcgaccgggtaaataccgcccgaagtccaaggggaacggggctcatccttcacggcccggggacggggattcgcggggaattcccatcaaatattccagttccgggttgcccttgcccataaaaaaaaccctgatgttgaaggcctccttttttgtggggataaagaaggctgaaaaatt

SEQ ID NO: 88960 - DNA, 1125 bp, Zea mays
  misc_feature: Ceres CLONE 1576464
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
gggtgggtgtgnnannnntaaaccgacacagaattagggcaaccaattacatttcggtttattttggtggtggtggaaaactgggactccccgcggtggcggccgctctagaactagtggatcccccgggctgcatgaattcgtctcacccctagaaaaaagggcaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggaggataaacaggaagagctaggtgaatacttggagaaaaaggtcccccacaccccccacgcaggtgaatactacaagtagcagtacaaagaagagagccaatctgcccgtgactgccagtgagtttctccggtgtggtggttaattggaggtcaccatgatgggagggggggctggaacaacccatcaaaacgtggtggttccctgggcgcccacaaaattcctggaacctcccctggcaacaaaaacgggcgaaccaaagaacccgggggggcttctgcccctcaactcattgcccggcaaaaacttacccttcccgggggggaaaccccatttggccgattggaattgtgggggggaaaaagggggttgaatatcccatccagtgtggggaaaaacccgagacccgcggcgcccgtagaaaaaaaagtgctggtattcccccacggggggaataaatcactcccccttggggctgatagaagggaacgccggaaatccagcgggctgcaattgtttaacacgtgaacccttttttggaaaaggtgagacaaatatccgcaaaggagaaaaaccccttggaagagacgccgcccctcccatgtgttgtggggccaccccaaaccccggccaattgtgaacaaactcctataaatagctggactcccacaggggaaggcccgctcccatgccttgaaacccccccgtggctatatggaattcccccgtgagactataaccgagtggggaggggccttgggccgaaaaacttgtcatttccataagccaaagtgcggttccgcaagtggccggtccccgg

SEQ ID NO: 88961 - DNA, 1158 bp, Zea mays
  misc_feature: Ceres CLONE 1576472
  misc_feature: Encodes the peptide sequence at SEQ ID NO. 88962
  misc_feature (17)..(17): n is a, c, t, g, unknown, or other
  misc_feature (18)..(18): n is a, c, t, g, unknown, or other
  misc_feature (49)..(49): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
attgaatttgaattaanngaaagaagagcgccataaaaaaataattgtntgnnngggnnncnnnnnnnnaaaaactggagctcaccgcggtgggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagggtggaactgacaaacacgctttagcgccgtcgtcgttctcgccgctgatttgtccgcccccccggggacgagagcccaacagggagccccccccggtgacgaaagaaggaaagggaacctcaatttctcattcaggcccgcggcccaacaaagggggaagcttccccccccccgggggtcggggaagtccccacgggaaaccaaaaaaatgtggggaaggggtttttttcttgaaaccccccattcggaagcggggggggggcttcccctccccgcggagagctttctatccccggcctaaacgagggaggaaagggtccccccccccccgggacccccctcgcttaactgaaaacagagcggtgttgtcgaaaaaaaaaacaaaaacccgccgcgttgttcaccaccccccctccaataatgggggtcgggcgatgaccttttgcaaaaggtaaaccacccggggggagagaaaaagaaaccttttctcttttccccccaagcaatcttctcggcgctgcctcgggcgagggggatattccgcggtaagagaaagagatataccccggggtacacctttcttttagcgctctcctgtgttagaacaaaaccattaaagggttcctacccaaatttttgggggaacaaaaggaagcgggccgcccaataggtcccatacaatgtggcgatactagatccctggcccactctcaatttggggtgaaggggtggtcgtgtttaccccaagacaaaag

SEQ ID NO: 88962 - protein, 32 aa, Zea mays
  misc_feature: Ceres CLONE 1576472
MAATVSSCLSLVPTVHHRAGGFPSRVELTNTL

SEQ ID NO: 88963 - DNA, 866 bp, Zea mays
  misc_feature: Ceres CLONE 1576474
  misc_feature: Encodes the peptide sequence at SEQ ID NO. 88964
catagctggagctccccgcggtggcggccgctctagaactagtggatcccccgggctgcaggaattcgtctcacccctagaaaaactcccctcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaaccttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcaacaatattgcttctggcacttcagaaaatacaaagggttgttattgatcatgggggctggttcctatattttgtgaagccttccttggggtctgggaagggaagaatgttccctgaaccaggccgggggtggggcttttggggcaatggtgcctgggcgaatccccccaaaatggtcggggaccctttggttcctggccaatgggtgggaattggatggccccccgggcttagccccctgtttgaaaa

SEQ ID NO: 88964 - protein, 152 aa, Zea mays
  misc_feature: Ceres CLONE 1576474
  misc_feature (4)..(92): Pfam Name: IBB Pfam Description: Importin beta binding domain
  misc_feature (101)..(142): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKNLESLPAMVSGVYSDDNNLQLEATTQFRKLLSIERSPPIEEVIKSGVVPRFVQLLTREDLPQLQFEAAWALNNIASGTSENTKGCY

SEQ ID NO: 88965 - DNA, 845 bp, Zea mays
  misc_feature: Ceres CLONE 1576476
  misc_feature: Encodes the peptide sequence at SEQ ID NO. 88966
  misc_feature (1)..(1): n is a, c, t, g, unknown, or other
naaagctggagctccccgcggtggcggccgctctagaactagtggatcccccgggctgcaggaattcgtctcacccctagaaaaagcctccctcggcgcgacgacctctcccccaggagagcctaccccctccctcattccccgcgcgacgaggccgcttaatggagggtcgcggccggcctcggccgggctcgctccaggctctcgtcgtcgccgccgccatcctcctcctggccgccgtgtccggggtcggcgctggatcccccgatcggcccgcgccggggccaccgctgttcctcccgctcacgcgctcgtaccccaacgccagccggctcgccgcctcgctgcggcgcggcctcggcgacggggtccaccccaacgcgcgcatgcgcctccacgacgatctcctcaccaacgggtactacacgacgaggctgtacatcgggacgcccccgcaggagttcgcgctgatcgttgactccgggagcaccgtcacctacgtgccctgctcctcctgcgagcagtgtggcaaccaccaggatccacgatttcaacctgacctctccagttcatattcaccagtaaaatgcaacgttgattgtacttgtgacagtgacaaaaaacagtgcacttatgagaggcagtatgctgaaatgagctccagcagtggggtgctttggtgaggacatagtgtctttttgcagagagagtgaacttaagccacagcatgctattttttggctgtgaaaatcctgaaactggagattttgtcagtcagcatgctgaatgttaatatggggccttgggtcctggtcaacctatccataatggatcagccttgttta

SEQ ID NO: 88966 - protein, 173 aa, Zea mays
  misc_feature: Ceres CLONE 1576476
  misc_feature: SWISSPROT Homolog: EC 3.4.23.12 Nepenthesin
MEGRGRPRPGSLQALVVAAAILLLAAVSGVGAGSPDRPAPGPPLFLPLTRSYPNASRLAASLRRGLGDGVHPNARMRLHDDLLTNGYYTTRLYIGTPPQEFALIVDSGSTVTYVPCSSCEQCGNHQDPRFQPDLSSSYSPVKCNVDCTCDSDKKQCTYERQYAEMSSSSGVLW

SEQ ID NO: 88967 - DNA, 844 bp, Zea mays
  misc_feature: Ceres CLONE 1576480
  misc_feature: Encodes the peptide sequence at SEQ ID NO. 88968
  misc_feature (844)..(844): n is a, c, t, g, unknown, or other
ctggagctccccgcggtggcggccgctctagaactagtggatcccccgggctgcaggaattcgtctcacccctagaaaaaacgcagcagcagccactctggtacgtgcggcgcacgggatgggatcgatcgtccatggattcattctataactgctgctgctgctactactagctaggggcagccgtcggtcagtggagtgttgtgggtattgattgccgtccgtcgacggcttcaatcgctgcccgttccggtgcgactgcccgactgctatataggcatgcacatagcctcgcgctctatcgcaaccctgcactgcgtgcgctccatgtgactctcacttatttctcctgtcagcgcagcagcagcagcagcagcctactactactactactgcttttaccggccggtggatcggatcaccaaaccggaacgacagcgatggaggccgggacgtgggcggcggcggccgtggcggccgtggcgctgtacgtggcctggttctggcggatgtcgcgcgggctcagcgggccgcgggtgtggccgctgctcggcagcctgccggggctcgtgcagcacgccgaggacatgcacgagtggatcgccgccaacctgcgccgcgcggggggcacgtaccagacctgcatcttcgccgtgccccgggtggcgcgccgtggcggcctggtcaccgtcacgtgcgacccccggaacctggagcacgtcctcaaggcgcgcttcgacaactaccccaagggccccttctggcacgcccgtctcagggacctgctcggggacggcatctttcactccgacgccgaacacctgggtggcgcagcgcaagacgn

SEQ ID NO: 88968 - protein, 134 aa, Zea mays
  misc_feature: Ceres CLONE 1576480
MEAGTWAAAAVAAVALYVAWFWRMSRGLSGPRVWPLLGSLPGLVQHAEDMHEWIAANLRRAGGTYQTCIFAVPRVARRGGLVTVTCDPRNLEHVLKARFDNYPKGPFWHARLRDLLGDGIFHSDAEHLGGAAQD

SEQ ID NO: 88969 - DNA, 851 bp, Zea mays
  misc_feature: Ceres CLONE 1576483
  misc_feature: Encodes the peptide sequence at SEQ ID NO. 88970
  misc_feature (46)..(46): n is a, c, t, g, unknown, or other
  misc_feature (106)..(106): n is a, c, t, g, unknown, or other
ggagctccccgcggtggcggccgctctagaactagtggatcccccngggctgcaggaattcgtctcacccctagaaaaaaaaaaaaaaaaaaaaaagactcaatancacaagcagagctcaaacaattcttggcttcccgctagctagctcgcaagaaataatggctccacttcttcttgcttctcgcacagcctgtcatcctggccttacaagcagccgccatgataatggccggcacggcctttcttcttcaccgggaagtagtagtaagcgaagccgtagccttagcttcataccacgagctgaaaagacgacgacaggcggtgagggtcatgttgtgagcgaaaagctgagcccctggcaaatccccaggagggagtggttcccccctagctttatctttggtgccgccacttcagcataccaaattgaaggcgcttggaacgaaggtggcaaggggccaagcacttgggacgacttctgccacaaatatccggagtggatagcggacgggagcactggggatgttggagcgaactcctactacctgtatagagaggatgtcagattgctgaaagagatggggtatggacgcctacaggttctctatcgcttggtccagaatactgccaaagggggacgctcgagggaggcattaaccataaagggcctcaagtactacaaaaggctcctccaacttggtgaaaaaaaaaacggctaaaaacccttttgtgaacacttttctccccgggggaaaccaccctcaaagcccctggggggaaaaaccacaccggggggctttctcttttaaaataaacaggattttttaaaaaaaaatatctcccccgca

SEQ ID NO: 88970 - protein, 186 aa, Zea mays
  misc_feature: Ceres CLONE 1576483
  misc_feature: SWISSPROT Homolog: EC 3.2.1.21 Beta-glucosidase
MAPLLLASRTACHPGLTSSRHDNGRHGLSSSPGSSSKRSRSLSFIPRAEKTTTGGEGHVVSEKLSPWQIPRREWFPPSFIFGAATSAYQIEGAWNEGGKGPSTWDDFCHKYPEWIADGSTGDVGANSYYLYREDVRLLKEMGYGRLQVLYRLVQNTAKGGRSREALTIKGLKYYKRLLQLGEKKNG

SEQ ID NO: 88971 - DNA, 798 bp, Zea mays
  misc_feature: Ceres CLONE 1576485
  misc_feature: Encodes the peptide sequence at SEQ ID NO. 88972
  misc_feature (573)..(573): n is a, c, t, g, unknown, or other
  misc_feature (626)..(626): n is a, c, t, g, unknown, or other
ctccccgcggtggcggccgctctagaactagtggatcccccgggctgcaggaattcgtctcacccctagaaaaaaggaggagaggaacggagagctggaaaaggcaggaaagacccggcttttgaccccaagtaccctgttgagggcaatggcggccacctccgaggaggcaatcaagcagttctcggcgctcatggagcagctagaggagccgctaaagagcacattccagaatgtgcatcaaggaaatctgagagggactttgatgcgttttctgaaggctagagaatggagtgtgcctaaagcttataaaatgctaatggattgcttaaactggagagtacagaatgagattgacatcgtgttagctaaacccattctgccatctgatatatatagagttattcgggacacgttacttgttggattgacagggtactccaagcagggacaacctgtttatgcatttggtgtgggtcttagtactttcgacaaggcctcggtgaactactatgtgcaatcacacatacagatgaatgaatatcgagatcgtgttgtcctgcccgctgcatncaagaagtttgggagacagattaatacctgcttgaagggtatggatatgactngggcctcagctgtctgcactgagcaaaataaagatgttgacgatgattaccactgttgatgaccttaatttttcctgagaaaaacgaaacctattactttggaaatgctcccatatgtttttcagcgtggttggaaaggttgggaaaccccccccttacaagaaagaactaa

SEQ ID NO: 88972 - protein, 178 aa, Zea mays
  misc_feature: Ceres CLONE 1576485
  misc_feature (2)..(69): Pfam Name: CRAL_TRIO_N Pfam Description: CRAL/TRIO, N-terminus
  misc_feature (142)..(142): Xaa is any aa, unknown, or other
  misc_feature (160)..(160): Xaa is any aa, unknown, or other
MAATSEEAIKQFSALMEQLEEPLKSTFQNVHQGNLRGTLMRFLKAREWSVPKAYKMLMDCLNWRVQNEIDIVLAKPILPSDIYRVIRDTLLVGLTGYSKQGQPVYAFGVGLSTFDKASVNYYVQSHIQMNEYRDRVVLPAAXKKFGRQINTCLKGMDMTXASAVCTEQNKDVDDDYHC

SEQ ID NO: 88973 - DNA, 849 bp, Zea mays
  misc_feature: Ceres CLONE 1576489
  misc_feature: Translation starting site: 157
tggagctccccgcggtggcggccgctctagaactagtggatcccccgggctgcaggaattcgtctcacccctagaaaaatcctcatcagccatccccaaaaggccaaaacccgcgcacaccggcgacggccggagaacctcctgccggccgccgccatgccgccgcctctacaggcccaccgcctactcatctcccaccgccgcctacccactccagctcgccgccggttcaccgccgcctcttccgtccaatccgctcccaccacaaccttggccccgggccccgccacatcctccatcctctccatccgcgagtcgctcctctcaggagagaggaccgcggcggacatcacctccgagtacctctcccgcctccgccgtaccgagccgaccttgcccaccttcatccacgtcgcggacgccgccgccgagcgggaggcggaagaactcgaccggaggattgcctccgggggagaagatgcggtggggtccgctcgctggagtgctggtgggagtgaaaggacatctttgcacagccaacatgccctcaacgggcgggtcgcggatactggaacggtaccgggccggcgtacaagccactgccttgcgggggcttgcggaaggccggccctattgggtttggggaaaaaaaaccccccacaaattcggaaagggggagacccccccgggggctcccccgttttcgggggaaaaacaaccccggggggaatatatccctgggggccgggggggaaacccccgggggggcttccccccccccaaatgttctcctaggaaaatggcgaaggtgccccccgaggggtgggcccaagggggggaaaagtggta

SEQ ID NO: 88974 - DNA, 816 bp, Zea mays
  misc_feature: Ceres CLONE 1576490
  misc_feature: Encodes the peptide sequence at SEQ ID NO. 88975
  misc_feature (572)..(572): n is a, c, t, g, unknown, or other
  misc_feature (608)..(608): n is a, c, t, g, unknown, or other
ccccgcggtggcggccgctctagaactagtggatcccccgggctgcaggaattcgtctcacccctagaaaaaacacacgatacgaactagccaaccagctgccgagggaggaatcctagcggaacactgtccaggtgacggcggcgcgctaccggtgacgggggatacggcggcatcgtcccctcctccatccccggcgcggcggcgccagcagccggcctgcagatcagctcaacaaagataaccttgcgccgcctcctaagaagatcaagactacccagccaggttctacagaccctcaaaaccttaatcgttagatcatcgccgttctcatgaagaattccggaggaggcgctgcccatggcgatggcggcgacatctacaatgtccgggccgccgagatcctcgccaacgaggccctcctgctccccatcaatgaggccgccccaatctacgagaatctgctcgccactttccccacggccgccaaatactggaagcagtatgtcgaagcctacatggccaccaacaacgatgaagccgccaagcagattttcagcagatgcctgctncactgccttcacattagtctatggcgctgttacatncactttatcaggagaattaacgataaaaggggctctgagggtcttgatgagacgaagaaggcttttgatttcatgctcaactacgttgggaatgatgcagctttctggccctgtttggatgaagtatattaatttcctcagtccatgcccggtgtgatgcccccatgaaaaatcccatcgcatgactactggttcgaaaagggaccaa

SEQ ID NO: 88975 - protein, 135 aa, Zea mays
  misc_feature: Ceres CLONE 1576490
  misc_feature (92)..(92): Xaa is any aa, unknown, or other
MKNSGGGAAHGDGGDIYNVRAAEILANEALLLPINEAAPIYENLLATFPTAAKYWKQYVEAYMATNNDEAAKQIFSRCLLHCLHISLWRCYXHFIRRINDKRGSEGLDETKKAFDFMLNYVGNDAAFWPCLDEVY

SEQ ID NO: 88976 - DNA, 946 bp, Zea mays
  misc_feature: Ceres CLONE 1576494
  misc_feature (14)..(14): n is a, c, t, g, unknown, or other
cgctgtgcaactgntggatcccccgggccgcaagaattcgtctcacccctagaaaaagttgagcgcttagactcttgttgtatttgtttttgtggtcggcgagcatggaggaggaggaggcggctcactggctctgattggcggacggcgcgtcggatcggacctctacatcttccgggatttactgtacctccggaagcgatgaaatgcggcgactaactggggaaccgagtggagctctagtgccagccactgttcctgctgacacctgcctcatctgagcccccccccttcgttcagttcttgtggccagttgttatatccaccgtgtccgggatccgattggcctcgggttctaaggagatggacgaaccaggaccccccctgggtgcgacgcaccatgtttctctcagtccatcggcatatccgcctctggctggggagcaagttttggcgcgtctcatcgaacatattgatcccgtgcgggcccagcctgaggacagaatggggttggggcacaagggtaacgaggaaaacccgcccccaggaattttaaacatacccttggggcaaaagggatccccggggggtcttccaaacttcttgccagggcgtgccccgatttcccccaagggcggaaaatccctcgaagggtgcccccagttctcggaaccctaaaagccggaaaaacaattagcttcttttcccgaaaagggcgcagatttgataccatatataacagggggattccgccccccttggccaaaagaatacaatcggggttaaaacccaaaaatccctgagaagggggggcgccttcctggccctctaatttttggagaaatttccgcgaaaatttgccatggtggggtgcccgccccctccccaaggggaagagcccgccaaacacggcgcggaggatatctccctattgcccccaccggag

SEQ ID NO: 88977 - DNA, 905 bp, Zea mays
  misc_feature: Ceres CLONE 1576495
  misc_feature: Encodes the peptide sequence at SEQ ID NO. 88978
ccgctctagaactagtggatcccccgggctgcaggaattcgtctcacccctagaaaaagccgcctacccaaacgcgtccaaaacattctgcagggaggaggagggcagcaccaatgatcacaggcaagctactgcctggcaccagcaagcttatgccctgccccgccccgccgccagaatccgagaccagtaaaccacagcggcaacaacctcacggcgcccgcgtggaaggcatgcggcccataaccgccagacagcgctactcctgctgcttcttctataggtccatggctgttgtctcgaaggaacgtggcgtgtcttgcccatcaacctcctgctacgagtcttctacgcggcaccgtctccagctgacagttgccacggctgcgagaacctgtccaaaggagcctactagcaggctaccaaggtcggccctcacaccgggtcagagtcggtacggcacctatggccgcgtccctcaaacagcgggaatgctctacgtcaaaaacccccaaggtcgtacaagggacggcgaaacgctgccagcaccattttctccaggagtgggtgccagggaagagcctaattgtttaatctaccgggcgggggctcaagggtgggtgggtaaccggaaccaaagtctacggaaactaaaaaaagcctcccgggagggcttttttgtttaagcgcccacaggaggttaatctgatccttggggccattgccctgcaaaggggcaagccctccaccaagggaacccggccccgtttcgcctaagggtgtaattttataaaaggcgtaacccttgctgtaaaagcccggaaggagacccccaaccccgtgataccttaccccgggaagaaaaaatgaacgggaaaacctaaacaaaaatggtgaaatttatg

SEQ ID NO: 88978 - protein, 42 aa, Zea mays
  misc_feature: Ceres CLONE 1576495
MAASLKQRECSTSKTPKVVQGTAKRCQHHFLQEWVPGKSLIV

SEQ ID NO: 88979 - DNA, 925 bp, Zea mays
  misc_feature: Ceres CLONE 1576499
  misc_feature: Encodes the peptide sequence at SEQ ID NO. 88980
tccccgcggtggcggccgctctagaactagtggatcccccgggctgcaggaattcgtctcacccctagaaaaaacgggtcaggaactcccaggaaagccgaggaggcagcctcgctgtgctcctgctgctgctccgcccttccgaccgatcgaggtggcgcaaagcagaggaaaaccccaggccgcaaccctcgcaaacactcaagtcctcgtcccttccgcaccctcctcttcaactccagccgctttcaccgccaatcagaggtccaccaccacatctcttcgcatccaaccgccccgtaggatcacagaaaacggggatggcgagcggcggggcggtgagggaggtgggctcggcggccgagctgcaggcggcggtggccggggcgcgggcccccgcggtgcacttctgggcgtcctggtgcgaggcgtccaagcagatgggacgaggtcttcgcgcacctcgccgtcgaacttcccccacgcgggcttcctcccgggttgaagctgaagaaccaccctgaaatatcagaaggcgtatgggagttacaggcgggggccactattttggttttttctgcaagggaagggcaaaacctgggccaattccttttgggagggggagccaaacccccaggccaggccttaagcccaataaggggttggccaaaaagtaaacctggggccccgccaaagggttttgccaaaagacttggccgtaaccttgctaagacccttggaaattttcttgcttgggaaccctgcttggttacttgaaaaaaactctccaaaaagaaggggcgcacaccggaaaaggggaattcttctggcctgtgtgaaaagaattaaacccccttggtgagcccccgaaaaaacccctttgagaaaaaacgccatgtgaaggcacccttggtcaaattttccc

SEQ ID NO: 88980 - protein, 67 aa, Zea mays
  misc_feature: Ceres CLONE 1576499
MASGGAVREVGSAAELQAAVAGARAPAVHFWASWCEASKQMGRGLRAPRRRTSPTRASSRVEAEEPP

SEQ ID NO: 88981 - DNA, 1259 bp, Zea mays
  misc_feature: Ceres CLONE 1576500
  misc_feature (42)..(42): n is a, c, t, g, unknown, or other
  misc_feature (43)..(43): n is a, c, t, g, unknown, or other
  misc_feature (986)..(986): n is a, c, t, g, unknown, or other
  misc_feature (1167)..(1167): n is a, c, t, g, unknown, or other
ttgggtgggttgggggtgggtgtttcgttttatttaaatttnnatatttgttttttttttttttttctcaacgtggcataaaactggaactccccgcggtggcggccgctctagaactagtggatcccccgggctgcaggaattcgtctcacccctagaaaaatctctctctcgcggagctccctggcgagcgcccctgctccctctgtcctctcccctgcagctctctcttggtgcccagaatcttctgcttacatcccctggccgtgtgcccctgcgccggtcgagttccctgcgctcgccggcgctcctccctggctcgcccctccacgcgcctctggccctccctgccgtgcgcctgcccaggtccgcgccgcctctgctcctcgttcttctctgcgagacgtgtagctccttcctgcgcgcgccggccgccagttcgtcttcaacgtccaaccatgtagctcctgcgcgtcgcgacttccccttcccccgagtttctcccctgccatggcagcacccctcccctgcatccggccttttggccccctcctgggcggcccatggagaaccccttgcccgtgccggtgaaaagcctttcccttgccttttgaaaagggcgtccttctcttctccctgtggcgccccccaaagctccaaaaaggccccccacttttgaattccgaggggatcattgcaggtctcactacctttatctttcccctttatttgtggtaccccccttcctcccgagacagatccagcacgactgggacgtatctacctatttcacattatgggtcttctccctccaggtgtttcctccactcggtgggccgcccggcgaaaaggcgcgctcagatctccgttctccctggccaccccgcccgagaaagaagacatcttccctcttttttttctcctcccctggtggctgtctctatgctcacaccattgggggggggagcgtcacgccattgttgggnaattccaaaattattatagttgaatccacccccacagggtaatgtggcagtgggagagaatcccccatttatatctctgctctgggcggggctgcgtgtgttcccagacacgaacaccgccttaatagaatttgcctccctcccagttcgctctcctcccgcccgtggttagacccgcccntagggaccacgatctcttatatattgtaatacacccctagggtcgcctactactgtcaagtggctcactttatggtgacctttcaataaaat

SEQ ID NO: 88982 - DNA, 1128 bp, Zea mays
  misc_feature: Ceres CLONE 1576501
  misc_feature: Encodes the peptide sequence at SEQ ID NO. 88983
  misc_feature (15)..(15): n is a, c, t, g, unknown, or other
  misc_feature (17)..(17): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (56)..(56): n is a, c, t, g, unknown, or other
  misc_feature (101)..(101): n is a, c, t, g, unknown, or other
  misc_feature (148)..(148): n is a, c, t, g, unknown, or other
  misc_feature (150)..(150): n is a, c, t, g, unknown, or other
  misc_feature (208)..(208): n is a, c, t, g, unknown, or other
  misc_feature (282)..(282): n is a, c, t, g, unknown, or other
  misc_feature (846)..(846): n is a, c, t, g, unknown, or other
  misc_feature (998)..(998): n is a, c, t, g, unknown, or other
  misc_feature (1038)..(1038): n is a, c, t, g, unknown, or other
  misc_feature (1056)..(1056): n is a, c, t, g, unknown, or other
aaaaaaaaaaccccncnggaagagggnnncggggggggggggggcgggggccttcngggggggcgggaaaaaaagagaaagggtggaggattaaacgtcgnaaggaggaaaaaaaaaatgtttcaaaagaggagggcgagaaaaaacncngcgagcccaggagaaaaaatttttctccctcacgatactctcgacgagagtgtctccntggccggaaaaggagacgggccggcgatcggcatcgacctcggtacgacctactcgtgcgtcggggtgtggcancatgaccgagtcgagatcatcgccaacgaccagggcaaccgtacaacgccggcttatgtcgcgttcaccgattcggagaggctcgtcggcgacgccgccaagaaccagggggccaggaaggcaatttttttttttttcgacgccaaccccctcagcggcgggggcttctcggacacgggggggcacacccaccccaaacaaatggcacttacaaagagaagccggggcttccgggagaaaagccccaaggattcgggggtggaagttcaagggggcgaaggaggaaacaagatactcgggccggagggagaaaccagctgcacatagaagcgcgcggaaccaagggatggaagagggagaaacaggacagagagggccagtgaaccttcgaggaaaaccaacggcgggtcgagaagaaagaaggcagtgtgagaagatccacccagcgaacacgccggggaagccttgacgcgtgagcagagcgagaagccgtcgcgacaagtgcgggccgatggggcggcgcgcgccgaatggtaagaacggcacacgggggggagacaaagncgaccgagagggtacgtctgaagggggatgccaagggagcagaataaacgagtgtaaagacggaaaggcgcaacaacgagaccccaaaagtagcaatcacaggcaaataacaggggggccacccagaaagagaagaaagggcgagaaggaanagcgaagaagcgcgttagtaaaagaaagcggaaccgccgnagatcgatgaggaaagcntgcgaggaggagcgggagaaaccgcgtcggaaaaagggagaaagcgaaccagaaaaagatagagaagagaag

SEQ ID NO: 88983 - protein, 163 aa, Zea mays
  misc_feature: Ceres CLONE 1576501
  misc_feature (11)..(11): Xaa is any aa, unknown, or other
  misc_feature (31)..(31): Xaa is any aa, unknown, or other
  misc_feature (55)..(55): Xaa is any aa, unknown, or other
MFQKRRARKNXASPGEKIFLPHDTLDESVSXAGKGDGPAIGIDLGTTYSCVGVWXHDRVEIIANDQGNRTTPAYVAFTDSERLVGDAAKNQGARKAIFFFFDANPLSGGGFSDTGGHTHPKQMALTKRSRGFREKSPKDSGVEVQGGEGGNKILGPEGETSCT

SEQ ID NO: 88984 - DNA, 876 bp, Zea mays
  misc_feature: Ceres CLONE 1576502
  misc_feature: Encodes the peptide sequence at SEQ ID NO. 88985
  misc_feature (432)..(432): n is a, c, t, g, unknown, or other
tagctggagctccccgcggtggcggccgctctagaactagtggatcccccgggctgcaggaattcgtctcacccctagaaaaagctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctggagctgctccctagggagctgagtgggcngggtggagacccacccagagctcccggcgctcgtggaggtggtcatggacctcggccggcccccgctcgcgcgcttcccgtccggagacttcctcctctcccaacgccccatctccttcgacgacctccgtcacgctacctcccaggttggggactttggagcggataatcgtgctggaatcagccgcacgctgcaccggatcagcgccattaggaatcggaagggcgtcattgtccgcctcacatgccgtgttgggcgtgcagtgcccgggagcgctatttgcttcaggatttggtttaaggacggtggtcattgcgggtcatgggccactggggggtggggagactactgtcatagaaaaattgcccctttgttagccgatgactttaagaaacgcggggagatgggcgaacatcttatgaaatggggggggggggagggga

SEQ ID NO: 88985 - protein, 133 aa, Zea mays
  misc_feature: Ceres CLONE 1576502
MDLGRPPLARFPSGDFLLSQRPISFDDLRHATSQVGDFGADNRAGISRTLHRISAIRNRKGVIVRLTCRVGRAVPGSAICFRIWFKDGGHCGSWATGGWGDYCHRKIAPLLADDFKKRGEMGEHLMKWGGGEG

SEQ ID NO: 88986 - DNA, 866 bp, Zea mays
  misc_feature: Ceres CLONE 1576504
  misc_feature: Translation starting site: 366
ctagaactagtggatcccccgggctgcaggaattcgtctcacccctagaaaaaatctctggcaactcctagaacgttcacggccacaccgccacacccacaccacacagcagtgcagcacggcgccccgcccctcgtactcggtgagatatatccccgccttccctcgcgaaagctctcgtagagacgacgacgacgacgacgacgacgacgacgcgagaagtcgaggcgccgctgcttgctaggaccgagcttcaggaagtctccaacggccccggcgccggcacggcctgccccgcgccgccacagggattgattgtgatcagatctattctgtagtggtcagcggctgagggtgaaccgaagatgagcgttgtgggattcgatctcggcaatgagagctgcattgtggcagtcgcgcggcagcgcggcatcgacgtgggtcctcaacgatgagttccaacgcgagacacccgccatcgtctgcttcggggacaagcagcggttcatcggtacggggggggccgcgtcctctaccattgaaccccaaaactcccttttcttagatcaagcgccttgctcgggcgcaagtttcttcgaccccgaagctccagaagggatctccgcgtccttcccggttccgggtcacggaggggccccggatgggatttccccttgggaacatggggcgggttccctgggcggaggaaacgggaaccttttcccccccccccaagctggttttggccatgtggggcgcggtcccattttgggaagggggctttgtcttgaagggggaaaccttttaagaacacggcgggtttgggttgaatttggttggacactggggccatccccctgggtggg

SEQ ID NO: 88987 - DNA, 989 bp, Zea mays
  misc_feature: Ceres CLONE 1576505
  misc_feature: Encodes the peptide sequence at SEQ ID NO. 88988
tggagctccccgcggtggcggccgctctagaactagtggatcccccgggctgcaggaattcgtctcacccctagaaaaagctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctgcacctgctccctagggagctgagtgggcgggtggagacccacccagagctcccggcgctcgtggaggtggtcatggacctcggccggaccccgctcgcgcgcttcccgtccggagacttcctcctctcccaacgccccatctccttcgacgacctccgtcacgctacctcccaggttggggactttggagcgggaaatcgtgctggaatcagccgcacgctgcaccggatgagcgccattaggtatcggaagggcgtcattgtcggcctcacatgccgtgttgggcgtgcagtgcccgggagcgctaatttgcctcaggatctggttaaggacgggggctcattgctgcccatcggcccacctgggggggggggaagactactggtctaagagaaattggcccgtatggttggcgaatgactataaggaagcgcgtggatgaattggccacccatcttaatgaaatggggtggggaatggggaattaccctccccccgcaataaggccatgtgtccttgggttgcgagtgccctaaccgagaacctggcccctatgggggcccagaatggaagctcgtggggaaaaccct

SEQ ID NO: 88988 - protein, 214 aa, Zea mays
  misc_feature: Ceres CLONE 1576505
MPPPPSPPPPLGLRLRLSLLPPHPIAPSIRHAFCSPSVVSCHLSVRPLAQRRGGRPRPLCAARGEAEAEGFAWPDGSEEELRRLLHLLPRELSGRVETHPELPALVEVVMDLGRTPLARFPSGDFLLSQRPISFDDLRHATSQVGDFGAGNRAGISRTLHRMSAIRYRKGVIVGLTCRVGRAVPGSANLPQDLVKDGGSLLPIGPPGGGGRLLV

SEQ ID NO: 88989 - DNA, 795 bp, Zea mays
  misc_feature: Ceres CLONE 1576506
  misc_feature: Encodes the peptide sequence at SEQ ID NO. 88990
ggagctcaccgcggtggcggccgctctagaactagtggatcccccgggctgctggaattcgtctcacccctagaaaaaatagaacggggttgcgaggtagcccaattctacagcactagtctttttcgtctcggtcgccatgtccttcagcgatgactaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcaggctgaaatattaacaatggagatgggaatggtgagatgcagggccgaggccgacgcccatcgtgcccgggagggtgcagctggtgagcaagaacaacaacatggctccactggaggagaatacccagaaggtgctgcttgagctgaccggcggcgactcctccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcatctgctgaagctcatcgacgacctccagcccggcggcaacaccaacatcagcgacggccttcaagacggggctcaaggtccttcgccgaccggaaggctcagcttccgggtcgg

SEQ ID NO: 88990 - protein, 126 aa, Zea mays
  misc_feature: Ceres CLONE 1576506
MAPLEENTQKVLLELTGGDSSSDRSGLDLVAVLDVSGSMQGEKIEKMKTAMKFVVKKLSSIDRLSIVTFLDTANRICPLRQVTEDSQPHLLKLIDDLQPGGNTNISDGLQDGAQGPSPTGRLSFRV

SEQ ID NO: 88991 - DNA, 788 bp, Zea mays
  misc_feature: Ceres CLONE 1576508
  misc_feature: Encodes the peptide sequence at SEQ ID NO. 88992
  misc_feature (770)..(770): n is a, c, t, g, unknown, or other
  misc_feature (771)..(771): n is a, c, t, g, unknown, or other
aaagctggagctcaccgcggtggcggccgctctagaactagtggatcccccgggctgcaggaattcgtctcacccctagaaaaaccctagggttcgcgccgccgcgctgaccctgtcgtagccatggggtcctcgctcccgcccaaggaagccaacctcttcaaagtcatcgtcaaatcctacgagactaagcaatataagaaagggcttaaggctgcagattccatattaaaaaagtttccagagcatggtgaaacactatcaatgaaaggtttgacgctaaactgcatggaccgaaaatctgaagcgtacgagcttgttcgacgaggcctgaagaatgatctgaagagtcatgtctgttggcatgtttatggtttgctttatcggtcagatagagaatacagagaagctataaaatgttacagaaatgcattgaggattgatccagataacatagaaattcttcgtgacttgtcccttctccaggcacagatgagggacttgtctggctttgttgagactaggcaacaacttttgtcgttaaaagcaaatcaccgcatgaactggattgggtttgcggttgctcatcatttgaaatctaaatccttccaggcagtagaaagtatgggaggcatacgagggaacactggaagatgattatccctccagagaatgaacggtatggaacccatgaaaatgctgctgtataaaatatcattggtttgaaaaaaagtggggaaggctagacagaggcctttgaagaaaatgcnnaagaaggggaagccaaa

SEQ ID NO: 88992 - protein, 177 aa, Zea mays
  misc_feature: Ceres CLONE 1576508
  misc_feature (77)..(110): Pfam Name: TPR_2 Pfam Description: Tetratricopeptide repeat
MGSSLPPKEANLFKVIVKSYETKQYKKGLKAADSILKKFPEHGETLSMKGLTLNCMDRKSEAYELVRRGLKNDLKSHVCWHVYGLLYRSDREYREAIKCYRNALRIDPDNIEILRDLSLLQAQMRDLSGFVETRQQLLSLKANHRMNWIGFAVAHHLKSKSFQAVESMGGIRGNTGR

SEQ ID NO: 88993 - DNA, 943 bp, Zea mays
  misc_feature: Ceres CLONE 1576512
  misc_feature: Encodes the peptide sequence at SEQ ID NO. 88994
ctggagctcaccgcggtggcggccgctctagaactagtggatcccccgggctgcaggaattcgtctcacccctagaaaaagcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatcccgacagatggtgaagatctgctgcatccgtgctggctatgtccgtgggccaaccatggccgtcatttgcctcaagtgcccagacaatgaaggtgtgccttggtgacatctcccaagcccgcattgagggtttggacaacggacaccctccccatctttaagccccggctccaagaagtttgtgaacaaatgcaggggccggaacctcctccttcacactgatgtttgaagaacaccccgcctaaaggtgacaatctccttcctccccggggaaaccccccccccaaaaccccgggggctttgaaaatgggaaagggtggcccaccccccccctcccttgggggaaagccgccctccctttaaatccccccaaattttcccccaccctggaaaaaaaaagtttttttgggaaaaaaccacccccccccccgcctaaaaaaccccccaaggggaattttttaaaaaaatatttttccccccccaacacgcagggggggtcaaacaaacccaaaatcctttttcaccccccgggattaacctttcgtgaaagggggcccgccttttttttggaaccagtttttatacccggcaaaaaatgtggcctcccctgggggccggggggaaacccccccggggggggaaagaaccgccccgccccctccccggaagtgtggtg

SEQ ID NO: 88994 - protein, 32 aa, Zea mays
  misc_feature: Ceres CLONE 1576512
  misc_feature: SWISSPROT Homolog: EC 1.1.1.22 UDP-glucose 6-dehydrogenase
MVKICCIRAGYVRGPTMAVICLKCPDNEGVPW

SEQ ID NO: 88995 - DNA, 1333 bp, Zea mays
  misc_feature: Ceres CLONE 1576516
  misc_feature (877)..(877): n is a, c, t, g, unknown, or other
tggtggtgtgttgtccttatgctctattcttctctcattaatattgtgcgtgttgtattatttcctttatttggggctccccgtcgtggcggccgctctagaatagtggatcccccgggctgcaggaattcgtctcacccctagaaaaagcacacacccacaagacagaacacaactcgtaagacacgagcgtcccccttcttcctctcagcaagcaccgcgcctaggaaggcagacatagatcgccgctcctctgctctccgtcggtggtgcggttgaccggcctcctcgagcgagatatctatggagtccgtccttatctggccacagatgttgccgacaagatggtgaagacctgctgtaccggtgctggctatataggtggtccatcaatgggagtgggttgccgtcaaccgccgccagattgatgtgtggggggtgggacagctccaagccctgcattgtggggttggtgcccccacaccctcccaacctacgagcgctgcctcaatgattctaggaattgttgctggggcgcatgaaaaccccttctttatctgggtttgtttgtacaagttagcacgctgagcggggacatcattctgcagtcccagacggaaccccctccccacaagacaaccctttgggtttctagaaggttggcaagggcatgacaaaacctaaagagttaatgggaaaggagagggctggctatcgttatttaatcagcgttaagtggtactcccataatcctttgtacaagcgactccctagctctataaccaatttcttttctctgtctgcctctgttcagtagaactctgtgtctcgaacggccatcccccagagaggtatatatcacctagagaaaatcgcncacggtaacctctgttatgacgggtgggcttatcatatatgcacacacacctgagattaccccctgtgtttctcaaatatccgcgcagagctatttgctccctcctgcaataatatgatgatttatctgcttgtcaacgtgggacatggaataatctactggcatctctccatgcgtgaattatataagcggttctagacgcacgcccgcgtattgagtaaggaagacacgcggtcagtacgctataagtcacatttttgtcacctcttatgtttaccatgggtgatctgccttattgcctaggaccgctcggtatcccggatgagtatttctgtacgccacatgagacacacttctctttgctgttccgagagtagtgattgatcacgaagagcgatcactgcgacgagtatatcccagcaaagcgcaatctatttcgttcgggttactacgcga

SEQ ID NO: 88996 - DNA, 820 bp, Zea mays
  misc_feature: Ceres CLONE 1576519
  misc_feature: Encodes the peptide sequence at SEQ ID NO. 88997
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
ctggagctccccgcggtggcggccgctctagaactagtggatcccccgggctgcaggaattcgtctcacccctagaaaaaacagcccagccctcgccccgtccgttcgtccgcccgcgcccgctgctgcttgcctgcttcccacgcacccgagctctgttccgtgctgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctccccagcacaacggtcacgtttccatcgccccgtcttctctccctcgtcgcatccggcgctcctcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccgccgcctccgccgccgccgcgtcggtctccggctccagaggttgcactgctgcaaggatggacagcggtgcggtggagacagcgtccactgggggagagctactcgacaactcgcgaggtcgaagccaggatcctgaagcggnnnnnnnnnnnnnnnnnnnnnnnnnnnnnnnnnnnnnng

SEQ ID NO: 88997 - protein, 81 aa, Zea mays
  misc_feature: Ceres CLONE 1576519
MLFSRRPLAAAFHLAPLSPPLLLFFASASSSCSPAASAAAASVSGSRGCTAARMDSGAVETASTGGELLDNSRGRSQDPEA

SEQ ID NO: 88998 - DNA, 825 bp, Zea mays
  misc_feature: Ceres CLONE 1576520
  misc_feature: Encodes the peptide sequence at SEQ ID NO. 88999
  misc_feature (814)..(814): n is a, c, t, g, unknown, or other
ctggagctcaccgcggtggcggccgctctagaactagtggatcccccgggctgcaggaattcgtctcacccctagaaaaaataatgagacatagaagaagaattcagagtaaccatgcgagaaagaaaattttagggtttagggtaccaagttggaactcgcactcgtatagtccaaaactaatggaattagccgacgcaaggcaagctttccgcttcctatttcggattgggatcatcagcggctgtagcgtggacccgacgggggtgcccggaccacatccctatttcatcttggtaccccgtccgtctccgatttcagaagcacggcgggctccccggcagcctcaaccgagcagaaagctgagttctaccccaggtgagagctgagttcaaattcccaattctcctccttgctttcgcagttgacatttaggctgggtccttgcgccgggcgggtatgggaataaatttcggcggatggggaggaaatttgtgcgtctccgctggctggcttgctggcattgggaagggccctattactcggtacgatggcatcaatagttgctcaggatgaagaaaacaatcgaactgtttttcttgtgtctatacagaaccgaggcatggaggacgaagaaaacatcgagggagaactgttgctcgtggagtcacaactccacgacatccaaggacaaattaaaacattactcgatcgccaagaggagttgtatgaacgccaggcacagttgaaggctttgctcgaagcatctaaattgaccagaaatacaacaattaacacatcttcagttgctccnggaagattggt

SEQ ID NO: 88999 - protein, 67 aa, Zea mays
  misc_feature: Ceres CLONE 1576520
MEDEENIEGELLLVESQLHDIQGQIKTLLDRQEELYERQAQLKALLEASKLTRNTTINTSSVAPGRL

SEQ ID NO: 89000 - DNA, 835 bp, Zea mays
  misc_feature: Ceres CLONE 1576522
  misc_feature: Encodes the peptide sequence at SEQ ID NO. 89001
  misc_feature (497)..(497): n is a, c, t, g, unknown, or other
ggagctccccgcggtggcggccgctctagaactagtggatcccccgggctgcaggaattcgtctcacccctagaaaaagcaccaagaagccaaagccaatggcgactctacctctgctcctgcacctgctatgggaggcctctccgtgggcccgtgcaggcgcggcgacggccgccgtggtgctggtgtggctagcggcctggacgcttgagtgggcgtggtggacgccacggcggctagacagagccctacgggcccagggcctcaagggcaccaggtaccgcctcctcaccggcgacgtgagggagaacgcccggctcaaccgagaagcccgcacgaagccactgccgcttgggagtcacgacatcatcccacgcgtgctacccatgttccacaaccccgtgaaggagaatgggacaaattcattcacttggtttggcccgattccgagggtgataattccagacccggaattaatgagagaaagtttgtctaancagtttggccactttggcaaaccactgtttagccgtgttggcaagttactagccaatgggctcgctaatcatgaaagcgagaaatgggcaaaacacaggagaattctcaaccctgcatttcaccatgagaaaaataaagcggatgctgccctgtattttgctacctgtttgtggccgaatttgattaacagatgggaaaaattcaatgtgctttcaaggaacctttctgaaattggacttctgggccttgagttcccaaattcttactgggggaaattttttctcaaaaaacccccatttggggagcccacttttccgggggggggtggggaaccttt

SEQ ID NO: 89001 - protein, 245 aa, Zea mays
  misc_feature: Ceres CLONE 1576522
  misc_feature: SWISSPROT Homolog: EC 1.3.3.9 Secologanin synthase
  misc_feature (133)..(133): Xaa is any aa, unknown, or other
MATLPLLLHLLWEASPWARAGAATAAVVLVWLAAWTLEWAWWTPRRLDRALRAQGLKGTRYRLLTGDVRENARLNREARTKPLPLGSHDIIPRVLPMFHNPVKENGTNSFTWFGPIPRVIIPDPELMRESLSXQFGHFGKPLFSRVGKLLANGLANHESEKWAKHRRILNPAFHHEKNKADAALYFATCLWPNLINRWEKFNVLSRNLSEIGLLGLEFPNSYWGKFFLKKPPFGEPTFPGGGGEP

SEQ ID NO: 89002 - DNA, 822 bp, Zea mays
  misc_feature: Ceres CLONE 1576524
  misc_feature: Encodes the peptide sequence at SEQ ID NO. 89003
  misc_feature (702)..(702): n is a, c, t, g, unknown, or other
ggagctccccgcggtggcggccgctctagaactagtggatcccccgggctgcaggaattcgtctcacccctagaaaaaatccaactcggcaactcctccaggcagcccggtgggtgggtcatctcttctccccacgtccacggcgatggcgctcgcgcccccgcactgctgacccactcccaccgcgccgcggactctccctccctccccgtggttttggttttggtaggtggtggagggttggtaggggccggggcgtgcctgtcggctggcggtttcgggaagcgctgccgcgatccttgcccggatctgggcgccacgatggaggacgccggccgcgagggcggcgctgccgcggagaatgggaccgagggggagggctacgtcctcgtcaaggccgttcccgagggggagggggaccccgccgccgccgccgccggaggcgatcgcgaggatctcgctgcctccgccccggcgatggcggtggcggtggcggctgcggacgaggccgcggcaccggccaagaagggtggatccggggccacgaaggcgaggccgcagaacggcagggtccccgccggaacttccgccgccgccgcgccgagggtgaagaagcccggggtcctctcacagagcgcctccttcccggcgcggggcgcggtggcggtcgcggccaagaaggccgcggcggcggttgctacncccaagcaggccaagggcgccgtgcccattggatcaaagacggcggcaggccggggcggtggagaagaaagcgagttcggcccggacacctgttgctcgccggccgatgcttgttaatct

SEQ ID NO: 89003 - protein, 165 aa, Zea mays
  misc_feature: Ceres CLONE 1576524
MEDAGREGGAAAENGTEGEGYVLVKAVPEGEGDPAAAAAGGDREDLAASAPAMAVAVAAADEAAAPAKKGGSGATKARPQNGRVPAGTSAAAAPRVKKPGVLSQSASFPARGAVAVAAKKAAAAVATPKQAKGAVPIGSKTAAGRGGGEESEFGPDTCCSPADAC

SEQ ID NO: 89004 - DNA, 775 bp, Zea mays
  misc_feature: Ceres CLONE 1576526
  misc_feature: Encodes the peptide sequence at SEQ ID NO. 89005
ctccccgcggtggcggccgctctagaactagtggatcccccgggctgcaggaattcgtctcacccctagaaaaaaacccagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgccgctggactcaaggtaaccgcgcagcagttctgcttcctttactcaacgaaggagggagcccagactgcagatttagttgatagctagcgagcggttactggttagggtcagttggtagattcagcagtccatggaccagtcggctttttctactggcacttgtcttctccctgttccccttgttggaaattcagccagctgacctcagatccagattccaccacgctacagatagttcggcctttctacatatattctgactggtaacgtagcgtcgtagatacctctcgagtgtgtcacggtcagctagtctttgctgccgagaagaccactgcagatttattttttttatcttgcccagaagtggtcatcaggtcagacgaacgatattaatctactggcactgggggtgctcaattagctgacgggttctgaatttggaaacttctactgatgaatgattttt

SEQ ID NO: 89005 - protein, 59 aa, Zea mays
  misc_feature: Ceres CLONE 1576526
MAAASAAAPTKTANIPATMRAVQYDSCGGGAAGLKVTAQQFCFLYSTKEGAQTADLVDS

SEQ ID NO: 89006 - DNA, 849 bp, Zea mays
  misc_feature: Ceres CLONE 1576530
  misc_feature: Encodes the peptide sequence at SEQ ID NO. 89007
  misc_feature (645)..(645): n is a, c, t, g, unknown, or other
  misc_feature (646)..(646): n is a, c, t, g, unknown, or other
  misc_feature (655)..(655): n is a, c, t, g, unknown, or other
ctccccgcggtggcggccgctctagaactagtggatcccccgggctgcaggaattcgtctcacccctagaaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatcccgcagcttgctgacaactgcaccgggcctccaggggcttcctggtcnntcaatgcgntggtggtggcactggctctggccttggttcctctcctccctgaccgcctgtctgtgggagtacggcagaaatccaggctggccttccctgggtaccaatctccccgggtggcaacctctggttggggaccttaacaaaggggggtcctcactccttcctcccggaagcccacggattcttccatcctgcccaaa

SEQ ID NO: 89007 - protein, 185 aa, Zea mays
  misc_feature: Ceres CLONE 1576530
  misc_feature (49)..(184): Pfam Name: Tubulin Pfam Description: Tubulin/FtsZ family, GTPase domain
  misc_feature (139)..(139): Xaa is any aa, unknown, or other
  misc_feature (142)..(142): Xaa is any aa, unknown, or other
MRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKEIVDLCLDRIPQLADNCTGPPGASWSXNAXVVALALALVPLLPDRLSVGVRQKSRLAFPGYQSPRVATSGWGP

SEQ ID NO: 89008 - DNA, 788 bp, Zea mays
  misc_feature: Ceres CLONE 1576531
  misc_feature: Encodes the peptide sequence at SEQ ID NO. 89009
  misc_feature (788)..(788): n is a, c, t, g, unknown, or other
gcggtggcggccgctctagaactagtggatcccccgggctgcaggaattcgtctcacccctagaaaaaacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggcggtcattgccctcaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatggtgagaagcacgtcgctgaggctgacatcatcttcgtctcggtgaacacccccccaagacccggggggcttggagctggcaaggctggcgacctcacctacggggagaaccctgcttcgtatgaacccccaatggtctcccagtctgaaaaagaatcgtttgtccaaaaaagtcccccccttcccctggtcaaaaaacccggctggagggcttatttggggaaaagaattccttgaacccccccctaacaaggccaaggggggtttttcaaacttttcccggaaaattccctttttttccaaaaccccccgggggn

SEQ ID NO: 89009 - protein, 149 aa, Zea mays
  misc_feature: Ceres CLONE 1576531
  misc_feature (2)..(136): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDGEKHVAEADIIFVSVNTPPRPGGLGAGKAGDLTYGENPASYEPPMVSQSEKESFVQKSPPLPLVKKPGWRAYLGKRIP

SEQ ID NO: 89010 - DNA, 963 bp, Zea mays
  misc_feature: Ceres CLONE 1576532
  misc_feature: Encodes the peptide sequence at SEQ ID NO. 89011
  misc_feature (842)..(842): n is a, c, t, g, unknown, or other
  misc_feature (901)..(901): n is a, c, t, g, unknown, or other
  misc_feature (932)..(932): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
ctggagctccccgcggtggcggccgctctagaactagtggatcccccgggctgcaggaattcgtctcacccctagaaaaagctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacacgtccgcgctgatgcagcagaacgcgccgctggcctcgtccaagccgtccgtgccggagacggagaccatccctccggaagagacgcttgacgacggcgacagcgcggataccggcgatctgcgtgggacggagcccggcttgccagaagctgccgtcatgaggaacgacatggcagcggggtccgacgagcccggcttgcccaccaggaaggacggcggcgggaatgcggaggccgagcccaccaacaagccatctgaggatggcaacggcggccaacaaggaggcaagatgacgtgcgacgagaacagcgtggacgagcggttcccgtacgcccggccgaccgtgtgcgagctgtccggcgacgtgcgcgtgagcccgaagcagaagacggtgtacttggtcaacccgtccggcggcggcggcgggttcgacgagagcgtcgagaagcggctccggccgtacgcccgcaagaacgactccctcatgcccagccntgaccgtgaagttcagtgggctcgggccccggccgcgccccaatgcacgaagcggcacnccgtggccccccggttgggttcttctgcagngacgannnnnnnnnnnnnnnnnnnnnnnnnt

SEQ ID NO: 89011 - protein, 269 aa, Zea mays
  misc_feature: Ceres CLONE 1576532
  misc_feature (238)..(238): Xaa is any aa, unknown, or other
  misc_feature (258)..(258): Xaa is any aa, unknown, or other
  misc_feature (268)..(268): Xaa is any aa, unknown, or other
MASTAYSRSSSNKLPGGERRLPPRLMRGLTSKFEPKKLGVGLVAGCCLALLTYVSLAKLFAVYSPVFASTANTSALMQQNAPLASSKPSVPETETIPPEETLDDGDSADTGDLRGTEPGLPEAAVMRNDMAAGSDEPGLPTRKDGGGNAEAEPTNKPSEDGNGGQQGGKMTCDENSVDERFPYARPTVCELSGDVRVSPKQKTVYLVNPSGGGGGFDESVEKRLRPYARKNDSLMPSXDREVQWARAPAAPQCTKRHXVAPRLGSSAXT

SEQ ID NO: 89012 - DNA, 828 bp, Zea mays
  misc_feature: Ceres CLONE 1576534
  misc_feature: Encodes the peptide sequence at SEQ ID NO. 89013
ctggagctccccgcggtggcggccgctctagaactagtggatcccccgggctgcaggaattcgtctcacccctagaaaaaaccttctcccaccgcccggcgcccgccatgtattctgccgaccactggggcggctcgttcgagatcgccgatggggcggcggatgatgaccacagcctcaacatggacgtggaccgcggcgcgctgtcagcgcggcagcaccactagctggaacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagactgctccgacgccaaggacgtcaagggtggcctcgtcggcggctactacgacgctggcgacaacatcaagttccacttcccgatggccttctccatgacgctgctgagctggtcggtgatcgagtacagcgccaaatacaaggccatgggggagtatgaccatgtcagggagctcatcaagtggggcaccgactatctgctactcaccttcaaactcctctgcttccaccatcgacaaggtataccccccaggtggggtgctgcttaaattaaacggccagcg

SEQ ID NO: 89013 - protein, 220 aa, Zea mays
  misc_feature: Ceres CLONE 1576534
  misc_feature: SWISSPROT Homolog: EC 3.2.1.4 Cellulase
MGRRMMTTASTWTWTAARCQRGSTTSWNETQQSWLLGPPEAKKKDKYVDLGCVVVKRKLLWWALWCVVAAFVLIGLPIIIAKSIPHKKPGPPPPDQYTEALHKALLFFNAQKSGHLPKNNGIKWRGNSGLSDCSDAKDVKGGLVGGYYDAGDNIKFHFPMAFSMTLLSWSVIEYSAKYKAMGEYDHVRELIKWGTDYLLLTFKLLCFHHRQGIPPRWGAA

SEQ ID NO: 89014 - DNA, 770 bp, Zea mays
  misc_feature: Ceres CLONE 1576535
  misc_feature: Encodes the peptide sequence at SEQ ID NO. 89015
ggagctccccgcggtggcggccgctctagaactagtggatcccccgggctgcaggaattcgtctcacccctagaaaaaaccaaacttcgacgactgcgccggccgtcggccgtcgctgccgccctattttgaccccatcgccggcgacgataatcgccagtttgtggataagggtcttttaagtcttcatatgaaactatccttttgatatacagctgaaggacaataactatcatggatgctactgcaaattcagatgtgcaaagggctgaggaatttaaacttatggcgaatgatgccttcaaggcaaacaagttctcgcaggctatagagctttacagtcaagccattgagctgaatagttcaaatgcagtttactgggcaaaccgtgcatttgcacacacaaaattagaggaatacggaagtgctgtgcaggatgctacaaaagccatcgaaaatgattctagatattcaaaaggttattatagacgaggcgcagcttatcttgcccatgggaaagtcaaggaagccctgaaagaatttcagcaggtaaaaaaatctgcccaaatgatccagatgcttccagaaaatttgaaagaatggcgagaaagctgtcccaaaaagattccgtttttaaaaaaagcaaaattctgcttgggggaattaattaaaagggggggtcccgtgggcaaaaacttttttttggccttccccttttttcctttgaaagagtgggaggccccccctttttttgcgggggaacccaaaaa

SEQ ID NO: 89015 - protein, 178 aa, Zea mays
  misc_feature: Ceres CLONE 1576535
  misc_feature (12)..(45): Pfam Name: TPR_1 Pfam Description: Tetratricopeptide repeat
  misc_feature (46)..(79): Pfam Name: TPR_1 Pfam Description: Tetratricopeptide repeat
  misc_feature: SWISSPROT Homolog: EC 3.1.3.16 Phosphoprotein phosphatase
MDATANSDVQRAEEFKLMANDAFKANKFSQAIELYSQAIELNSSNAVYWANRAFAHTKLEEYGSAVQDATKAIENDSRYSKGYYRRGAAYLAHGKVKEALKEFQQVKKSAQMIQMLPENLKEWRESCPKKIPFLKKAKFCLGELIKRGGPVGKNFFLAFPFFPLKEWEAPPFFAGEPK

SEQ ID NO: 89016 - DNA, 1013 bp, Zea mays
  misc_feature: Ceres CLONE 1576540
  misc_feature: SWISSPROT Homolog: EC 3.1.3.16 Phosphoprotein phosphatase
  misc_feature (786)..(786): n is a, c, t, g, unknown, or other
  misc_feature (787)..(787): n is a, c, t, g, unknown, or other
  misc_feature (868)..(868): n is a, c, t, g, unknown, or other
  misc_feature (911)..(911): n is a, c, t, g, unknown, or other
  misc_feature (916)..(916): n is a, c, t, g, unknown, or other
  misc_feature (953)..(953): n is a, c, t, g, unknown, or other
  misc_feature (977)..(977): n is a, c, t, g, unknown, or other
  misc_feature (997)..(997): n is a, c, t, g, unknown, or other
  misc_feature (998)..(998): n is a, c, t, g, unknown, or other
tccccgcggtggcggccgctctagaactagtggatcccccgggctgtaggaattcgtctcacccctagaaaaaaccaaacttcgacgactgcgccagtcataggccgatctctgccgccctattttgaccccatcgccggcgacgataatcgccagtttgtggataagggtcttttaagacttcatatgaaagtatccttttgatatacagctgaaggacaataactatcatggatgctagtgcaaaatcacatgtgcgaagggctgaggaatttaaacttatggcgaatgatgccttcaaggcaaacaacgttctcacaggctatagagctttacagtcaagccattgagctgaatagtacaaatgcaatttactgggcaaactgtgcacccccacccacaaaattttaggaaatacagaagtgctgttccaggatgccaacaagagcccattggaaatttgtttcctaaaaagttcaaaaaggttttttattggaagaaaggccccaactttatttttggccctgggggaaagggtacccgggggaagccccccggaagggaaattttttcgagcagcggtttcaaaaaaaaaaatcgtgggccccaaaaatgtgtttctctcaagagagtcgtgtcccaccaacacacacggtttgtaaaaaaaataaatgggattagaaaaaaaaagagctgtctgaccacaaaaaaaaaaacacgcgtttatgtttgtgaaaagaaacgacccacctaactctttctcggtcgagcgggtaagaaaggagnnattaggcagtgcggggtgggtgtgttatctgtccgaacgcggggagtagaagagggttacgttacgttatttccgcgtctntttcgtggggggtgtgtgtaccactatcagtgaggtgtggggngttgnggcccccatatcataatgtacgtaggaaggagggggngcccccccaccaccaacaccaccncccccccccgccccccacgnnccaacacacaccaca

SEQ ID NO: 89017 - DNA, 910 bp, Zea mays
  misc_feature: Ceres CLONE 1576542
  misc_feature: Encodes the peptide sequence at SEQ ID NO. 89018
  misc_feature (749)..(749): n is a, c, t, g, unknown, or other
  misc_feature (890)..(890): n is a, c, t, g, unknown, or other
ggagctccccgcggtggcggccgctctagaactagtggatcccccgggctgcaggaattcgtctcacccctagaaaaaattcccaatctcgtcttgtgttgtttggagcggggaggagcatacattcccgtgctaatcctagtctatcttcttcccctcctcggggaggaaaagaagatgaaccatggggaagagaaagtctgctgctaacccacctcctaagaagcggatggacaagcttgacactgtcttttcctgcccattctgcaaccaccggagtagtgtcgactgccgaattgacatgaaaaatctgattggcgaaccatcttgcagaatctgtcaagaaaacttcgacaccactgttaatgcactcactgagcctattgatatatatagtgaatggattgatgactgcgagcgtgtctacatctgttgaaggcgaccatgatgcgtgagcttgccccttgtgatgaaactgtgaccgacgatcggaatgtaatgtactagaattctcgaatgccttaacacatagccagccttggcttgtaataacgcagtgagcatgactgatatgccactaggcaccttatctagtactgacagaactacaaaaagtgtgctactatacatgatatggacaaccttgtaagtggcgatgcgtgtacctatgctaacgctaatgccacatggtgtatcaacgtttctctgtgagattgtattgcctcaagtcgttgttcgttcgctaccantgtcagtgagaagatgtcctcatctttgatcttggaggtgtccctttgctgactgcctcctaacactgatgccgcatcctgcatgcatggacctgctgtgaacccatgcttgttggtcagattgtgcacaggacggcaacnaatgaggcagacctcagagg

SEQ ID NO: 89018 - protein, 83 aa, Zea mays
  misc_feature: Ceres CLONE 1576542
  misc_feature (8)..(68): Pfam Name: Elf1 Pfam Description: Transcription elongation factor Elf1 like
MGKRKSAANPPPKKRMDKLDTVFSCPFCNHRSSVDCRIDMKNLIGEPSCRICQENFDTTVNALTEPIDIYSEWIDDCERVYIC

SEQ ID NO: 89019 - DNA, 1087 bp, Zea mays
  misc_feature: Ceres CLONE 1576547
  misc_feature (22)..(22): n is a, c, t, g, unknown, or other
  misc_feature (45)..(45): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (64)..(64): n is a, c, t, g, unknown, or other
  misc_feature (66)..(66): n is a, c, t, g, unknown, or other
  misc_feature (69)..(69): n is a, c, t, g, unknown, or other
tttttttgcggcccaaaaaaanacgtaaactccctacaaaccatnactncccannnaatggtananaanaaaaactggagctccccgcggtggcggccgctctagaatagtggatcccccgggctgcaggaattcgtctcacccctagaaaaagcctcattcccttccttccttgctcctcccctgcctcgcctctctctctcccctctcctcgcctccagctcctgctcggcccgctcgcgtcgagctgcgcgcgcgcctgcggtggccgtgaaggacagcccgagggacgcgccgggtgcactgatctgggggccgcgtgtccccggtggtggggcgaggcggcgccggcttccaggaatgggcaacttgtagcgtcggtttcttttgcatatgcactttctattgttgttgtcatttcaaaggaggccatagtctcctggattttgtatgccttgttatctggaattggtgaccatagatgtcattccgtagcataatccgtgatgttagggatggcttttggcagcttgtcgaggagaagctttgaggtgaccctcgcaagcatttatgggccttactggggcatcacaaaggggaagtacccagagctcatccacatgtgtctcggacgaacccaaccttcccataaattcgttgaaaaattccaaatgggccgaaattctaaccctccctgaaaactcattccggtggaaaaattcataacgggaaaaacactcggaaggccctcgaatgaaagaaggccacccctggggcctcaggccgcgcgggaaaagaccccagttccggtttttggccttttccccacaagctttgattttggctaaggccaccatttgggaagaaagaaaaattggtggtaaaaaaggaaaatatgggtggttttgaaagcccccagagaattttcattgtgggcgcaaaaggacttcaacccattttcccctgtgggtgccaccataaaaaaaaaagccccttggacacccctctgaaagaattggaaaaaaaaccaaaacggggtcccccagagggtttttcaataaaacagaagagaaaataaaaattccag

SEQ ID NO: 89020 - DNA, 635 bp, Zea mays
  misc_feature: Ceres CLONE 1576548
  misc_feature (266)..(266): n is a, c, t, g, unknown, or other
  misc_feature (303)..(303): n is a, c, t, g, unknown, or other
  misc_feature (339)..(339): n is a, c, t, g, unknown, or other
tggagctcccgcggtggcggccgctctgaatagtggatcccccgggctgcggattcgtctccccctagaaaaattcttctctctccttcttcctcggtcctctcctctccgcatttcgtggcctccttcttctccggttctcgctcgtgcccttctctcctggcggcgacggctgggcgagcggcgcggcccgttatcacttcccaggtcttcggcggcgacgagtttccaccaggtacgcctcgtcccttcccctttcatccccngttccttactggtccctttccgcccgtccggaaaccngagcaccccccccaccccttgggtctccctggtccngaatttgggaaatctggacccccagattagaacggccaccccaaaggtgcccattttgttggggatccccgccccccaaggcttcccctgttggccccggcaatttcaaccaaggaatttttttggggggccaatttttcttggcccaggggccttgaaaccccgggaaaaaccccccccaattggggggttggggggaaagaaaaacccccgggggttggaagaccaaaagtccttggcccaaaaccccccattgtgtttcccccctttgggggggcgggggccccccggggggg

SEQ ID NO: 89021 - DNA, 878 bp, Zea mays
  misc_feature: Ceres CLONE 1576550
  misc_feature: Encodes the peptide sequence at SEQ ID NO. 89022
  misc_feature (437)..(437): n is a, c, t, g, unknown, or other
  misc_feature (438)..(438): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (478)..(478): n is a, c, t, g, unknown, or other
  misc_feature (599)..(599): n is a, c, t, g, unknown, or other
  misc_feature (606)..(606): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (624)..(624): n is a, c, t, g, unknown, or other
  misc_feature (631)..(631): n is a, c, t, g, unknown, or other
  misc_feature (635)..(635): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (664)..(664): n is a, c, t, g, unknown, or other
  misc_feature (696)..(696): n is a, c, t, g, unknown, or other
  misc_feature (697)..(697): n is a, c, t, g, unknown, or other
  misc_feature (794)..(794): n is a, c, t, g, unknown, or other
acccgcggtggcggccgctctagaactagtggatcccccgggctgcaggaattcgtctcacccctagaaaaactccatcccgcatcgcgcatcgcatccaccgccgagcttgctttctttctttcttttttctgggagaagaggaagaagaggggaggcgcgataaaaagggcgccgcgccccgccccgccccgcatcgcccccgacgccggcatctctccctcgctcaccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcgggcccaagtcgggcctccgtccgacaccattttccttcccnngggggnnncgataagagagcggcaggaagttattcgttgnactctattgccccgccgccggcggggcgggggtaacattagtgttttgtgtcgtggggcgcgggggggcgggatgagacagagcgacacatatgttcgcgtggcacagcagaggatggggngtggtgnggggnnnngagagcaagngacgggngaananntnnnntcacactcacacacacaaatntctctctgagctgcgcgtgtcactgggagggnntggggtcaagttagaagcagatggggaggcacagatccatcttggagggaaagagaacgtcgttcattttttaatggggagggaggtgtagcccgancactaagtttctcaccggtaggtatccataactcgcaggtcgttttagggtggtggaacgctgtgtctgtcgtccctcgggtga

SEQ ID NO: 89022 - protein, 54 aa, Zea mays
  misc_feature: Ceres CLONE 1576550
  misc_feature (51)..(51): Xaa is any aa, unknown, or other
  misc_feature (53)..(53): Xaa is any aa, unknown, or other
MHSTNLLLEEPIRMASILEPSKTSFFPAMTKIVGTLGPKSGLRPTPFSFPXGXR

SEQ ID NO: 89023 - DNA, 883 bp, Zea mays
  misc_feature: Ceres CLONE 1576551
  misc_feature: Encodes the peptide sequence at SEQ ID NO. 89024
ggagctccccgcggtggcggccgctctagaactagtggatcccccgggctgcaggaattcgtctcacccctagaaaaaacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatggatcaaaggctactggtgccttcatcttgacagcgagccataacccaagtggtcctaccgaggactttggtatcaaatacaatatgggaaatgggtggggaccctgccccctgaatcccgttacccgacaagatttttctctaaatacaaacaacaatcctctggaaaaccttcctcctctgaaagaacctttacaggatggttggaaattttccgggttggccgggggtccacccagccttatccattgggaaaccccgaaagggcccccacttttgaaatggggggaaatggtccctttttggaactccttagagggggtgaaaaatttttcacctgtaaagaa

SEQ ID NO: 89024 - protein, 226 aa, Zea mays
  misc_feature: Ceres CLONE 1576551
  misc_feature (16)..(168): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPSGPTEDFGIKYNMGNGWGPCPLNPVTRQDFSLNTNNNPLENLPPLKEPLQDGWKFSGLAGGPPSLIHWETPKGPPLLKWGEMVPFWNSLEGVKNFSPVK

SEQ ID NO: 89025 - DNA, 896 bp, Zea mays
  misc_feature: Ceres CLONE 1576552
  misc_feature: Translation starting site: 164
  misc_feature: SWISSPROT Homolog: EC 3.4.22.34 Legumain
  misc_feature (568)..(568): n is a, c, t, g, unknown, or other
ctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaaggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaattttctcgctngtctgcttggcaacaaaactgctctcaggggtgggagcggcaggtttgtgacagtggccccatgatcatatatttgttttccacgtgaacaatggggtccttgcctccctgggaatgctactgttcaattccctatggggaggacccccaaaaattcccgaaaaaaaaccagcgtgccgggaccaaaaaaactgggccttttacctgaaacaggcaaactggaaacacctttagaggccccccgccaagggaaataatgtgtttgcaaaccccccccaaaaaccaaaagaaaataccgggggaaaaataccccctggaaattcccaat

SEQ ID NO: 89026 - DNA, 824 bp, Zea mays
  misc_feature: Ceres CLONE 1576554
  misc_feature: Encodes the peptide sequence at SEQ ID NO. 89027
  misc_feature (631)..(631): n is a, c, t, g, unknown, or other
ctccccgcggtggcggccgctctagaactagtggatcccccgggctgcaggaattcgtctcacccctagaaaaagtgttcatctccctactcgatcggcagccgcaagagctgaccctccgcttccccccaaaaaccctagccatcccaggttgctccggccgcatccccgccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacgaagttggctatcccagctgagaattttcctttctgtaccatcgaaccaaatgaagcacgggtgaatgttccacatgaacggtttgattggctttgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtccctagagcatttgaagacgcagaaattactcatgttgacgatacagtagatcctgttagagacatggnaaactatttagttgaagagctcagactaaaagggataatagagtttcatgaaaaaaagaaaactttgagggacccttggaataaggtccaatggaaagaaggaacgccatgtggtaaaggccccccctccccaaaaaatttttggggccgcggggaaatattttttttttttcaaagaggaagggggtctcac

SEQ ID NO: 89027 - protein, 211 aa, Zea mays
  misc_feature: Ceres CLONE 1576554
  misc_feature (24)..(137): Pfam Name: MMR_HSR1 Pfam Description: GTPase of unknown function
  misc_feature (147)..(147): Xaa is any aa, unknown, or other
MPPKAKKDAAPSERPILGRFSSHLKIGIVGLPNVGKSTFFNIVTKLAIPAENFPFCTIEPNEARVNVPHERFDWLCKLYKPKSEVPAYLEVTDIAGLIRGAHAGDGLGNAFLSHIRAVDGIFHVPRAFEDAEITHVDDTVDPVRDMXNYLVEELRLKGIIEFHEKKKTLRDPWNKVQWKEGTPCGKGPPSPKNFWGRGEIFFFFQRGRGSH

SEQ ID NO: 89028 - DNA, 974 bp, Zea mays
  misc_feature: Ceres CLONE 1576556
  misc_feature: Encodes the peptide sequence at SEQ ID NO. 89029
  misc_feature (1)..(1): n is a, c, t, g, unknown, or other
  misc_feature (32)..(32): n is a, c, t, g, unknown, or other
  misc_feature (55)..(55): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
ncccatatccccacaaaaacgcgggcccaaantccataaaactataagtagtgtntttcccnnnnnnnngggnnnnngnnaaaaactggactccccgcggtggcggccgctctagaactagtggatcccccgggctgcaggaattcgtctcacccctagaaaaaagcgaagaggagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaaggagttgcatggtttgattggcctgggcctttgatacttgaaatacaacgattgggtggattcagccgtttggcccgtgggcaattttctccctaaatctaagccctttattttttttgggagggaacagggattagctcctgcccattgggattttttacgcaacggacaatgaaggatcccccatgggcttttgaatgttccggttgctaagaatcccctttggtggcgtttcctttcccctcgggtttttccgtcccggtccaccggggcccctttcctcctggtgggtgggggggaatttaaaaaggaagaaagttttccatttttgtttggccaagggagaccattgttggaacagggggt

SEQ ID NO: 89029 - protein, 112 aa, Zea mays
  misc_feature: Ceres CLONE 1576556
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGERSCMV

SEQ ID NO: 89030 - DNA, 793 bp, Zea mays
  misc_feature: Ceres CLONE 1576557
  misc_feature (362)..(362): n is a, c, t, g, unknown, or other
  misc_feature (391)..(391): n is a, c, t, g, unknown, or other
  misc_feature (396)..(396): n is a, c, t, g, unknown, or other
  misc_feature (397)..(397): n is a, c, t, g, unknown, or other
  misc_feature (403)..(403): n is a, c, t, g, unknown, or other
  misc_feature (404)..(404): n is a, c, t, g, unknown, or other
  misc_feature (588)..(588): n is a, c, t, g, unknown, or other
  misc_feature (589)..(589): n is a, c, t, g, unknown, or other
  misc_feature (742)..(742): n is a, c, t, g, unknown, or other
  misc_feature (781)..(781): n is a, c, t, g, unknown, or other
tggagctccccgcggtggcggccgctctagaatagtggatcccccgggctgcaggaattcgtctcacccctagaaaaaatttcgcctccgtttccaactcccagtgccggtcttccactcctcccttcttcgcctcccaatttccaaacctctctcttgggactgggagcacgtacacgcggaggaaaagcgatcggcgccgcggcggcaagatgactgcggcggcgacgatgacgtggcacgaggacctggccactctcgtgggggacacggacgttcacctcaccggcgccggggggcacgcgccggcgccggcggatgttacgccggcgggggcccgggtggtacgggggaggaggaanaagtgagggcggatggaagggggttgggncccannaagggnnaaaaggggttcccccggaaatcaacgggcgggaaaatgcttgcgggggaaactgggggcccctgggggcccttgtggggaaaaaacccccccccacaaaaaaaaaaaacccccccccgggggcgccccaagaaaaaaaacaaaaaaccctccccgggggggggggtggtcttttaaaaaaaaanngggatggggggggggggccccccccgggggggggaggagaccccccccccccctttttttttaaaaagaaaaaaaacacccctccctcgcccgcggagggggggcgccccccccccccccccctttgaggagggggggatttttggggtaacnatcacacattccccacggcggagtggaagaatatatttntttttttttatt

SEQ ID NO: 89031 - DNA, 813 bp, Zea mays
  misc_feature: Ceres CLONE 1576558
  misc_feature: Encodes the peptide sequence at SEQ ID NO. 89032
  misc_feature (785)..(785): n is a, c, t, g, unknown, or other
  misc_feature (804)..(804): n is a, c, t, g, unknown, or other
ctggagctccccgcggtggcggccgctctagaactagtggatcccccgggctgcaggaattcgtctcacccctagaaaaaatacctttctcggccttttggctaagatcaagtgtagtatctgttcttatcagtttaatatctgatatgtggaccatgtgttcacttcgatattaaatttattttttgtgggggagggtccactacagtggcttgccactgggcccctcgagcgtcgctcggccgttgcactactggctgagcctggcgcaccccaaatcgcctccacgaacaaaccacacaccccacctaccccggccggaccggcaggcagcacaacatggacctcgccctcctggagaaggccctgctgggcctgttcgccgcggctgtggtggccatcgccgtggccaagctgagcggcaagcggtaccgcctcccaccggggcccccgggcgcccccgtggttggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaacccgcgccnggtgggtagatgaggcccngctggtggt

SEQ ID NO: 89032 - protein, 152 aa, Zea mays
  misc_feature: Ceres CLONE 1576558
  misc_feature: SWISSPROT Homolog: EC 1.14.13.11 Trans-cinnamate 4-monooxygenase
  misc_feature (149)..(149): Xaa is any aa, unknown, or other
MDLALLEKALLGLFAAAVVAIAVAKLSGKRYRLPPGPPGAPVVGNWLQVGDDLNHRNLMAMAKRFGDIFLLRMGVRNLVVVSTPELAKEVLHTQGVEFGSRTRNVVFDIFTGKGQDMVFTVYGDHWRKMRRIMTVPFFTNKVVAQNPRXVGR

SEQ ID NO: 89033 - DNA, 793 bp, Zea mays
  misc_feature: Ceres CLONE 1576560
  misc_feature: Encodes the peptide sequence at SEQ ID NO. 89034
ctcaccgcggtggcggccgctctagaactagtggatcccccgggctgcaggaattcgtctcacccctagaaaaattatgctcggtccctcctagacgactgccaggctagtgctcccttcctcaccctggaaccagtccgcctaagcccgcccgccatgccgggcctcggcgcctccgacaactcgcccccggagccggcgccgccgccgcgccggctctcgtcaccgctaccccgtcgcgcgccgtcgtccccgtcgccgtccgcctcctcgcgcgccaagcctcggaagccctcgccctcgcccgcggccttccccaccgacgccgacgactcgctcgacaacccggatctggggcccttcctcctcaagcaggcgcgcgacgccatggtgtcgagcgagggcggtggcgcctcgcgcgcactctagttcgccgagcgcgccgccatggcgctcgagcgacgcggcgagggcgccgagctcgagctcgccatgagcctccacgtcgcccgcgccatccactgcggcctcggccgccacgctgacgccatccccgtcctcgagcgcgccgtctcagtcgtcacgccgccgccagaggcgcctggcgacggcgaggccaaaccctatggcggtgctaccggcggcgtactaccacaggcagctgcaggcctgccgaagccggaccagaggggccgaggagtggttcccctggctaccttctccgggttggatggcggcttcggaggacccccaaagcccatggctttgggcccgcttgggaccaactcccgtc

SEQ ID NO: 89034 - protein, 115 aa, Zea mays
  misc_feature: Ceres CLONE 1576560
MALERRGEGAELELAMSLHVARAIHCGLGRHADAIPVLERAVSVVTPPPEAPGDGEAKPYGGATGGVLPQAAAGLPKPDQRGRGVVPLATFSGLDGGFGGPPKPMALGPLGTNSR

SEQ ID NO: 89035 - DNA, 955 bp, Zea mays
  misc_feature: Ceres CLONE 1576562
  misc_feature: Encodes the peptide sequence at SEQ ID NO. 89036
  misc_feature (838)..(838): n is a, c, t, g, unknown, or other
  misc_feature (875)..(875): n is a, c, t, g, unknown, or other
  misc_feature (916)..(916): n is a, c, t, g, unknown, or other
  misc_feature (955)..(955): n is a, c, t, g, unknown, or other
ctccccgcggtggcggccgctctagaactagtggatcccccgggctgcaggaattcgtctcacccctagaaaaactactctccttcggcaaagaaagcaagtcagcctcaccctctcacaccaccgccactcactcagtgctccaccccaagaaccaagcagctcacccccatggcgtcctacgacaaggccttcgaatcctacaagaaggccctcaccaccgccgcgtccgtcgctgcgtccatgatgctggtgcgcagcgtcgtgaacgagttggtgccgcccgagttgcgcgatctggtcttctccggcttcggctacctgcgctcgcgcacgtcgtccgaccacaccatcatcatcgagaagaagaacgacgggttcgctaacaactacgtctactgcgctgtgaagacttacctcgccacgcgcatgaacaccgacatccagcagcgcctgcgcgtcagcagcatggacgaggacgacaagatgatggtcagcatggatgagggcgacgagatgctcgatgtttatcaaggcacggagttcaagtggtgccttgtctgcaaagacaactcaaatgactccctcaacagcagccagaacgagtcccacttcttcgagctgaccttcaacaagaagcacaaggacaaagccctcagatcgtacctcccgttcattttggccacagccaaggccattaaagcccaggagagaacctcatgatacacatgactgagtacggcaattggtccccgattgactccaccacccatctacattcgacacgcttgccatggacaagaagctgaagcagtcatcatcgatgaactggacaggntcatgaaagagaaagattactacaggatgattggcanggcatgggagcggggtttaccttctgtatgtccacctgggnactgggaagtcagcctatcgcagcatgggccaacatctn

SEQ ID NO: 89036 - protein, 183 aa, Zea mays
  misc_feature: Ceres CLONE 1576562
MASYDKAFESYKKALTTAASVAASMMLVRSVVNELVPPELRDLVFSGFGYLRSRTSSDHTIIIEKKNDGFANNYVYCAVKTYLATRMNTDIQQRLRVSSMDEDDKMMVSMDEGDEMLDVYQGTEFKWCLVCKDNSNDSLNSSQNESHFFELTFNKKHKDKALRSYLPFILATAKAIKAQERTS

SEQ ID NO: 89037 - DNA, 977 bp, Zea mays
  misc_feature: Ceres CLONE 1576567
  misc_feature: Encodes the peptide sequence at SEQ ID NO. 89038
  misc_feature (803)..(803): n is a, c, t, g, unknown, or other
aaagctggagctccccgcggtggcggccgctctagaactagtggatcccccgggctgcaggaattcgtctcacccctagaaaaaatcaattcatcacggcatcacccccaatttcttctactccaccgaaacataaatccgtagcctggtcttctgcttcgcagaaagatcttgcggaaggtggcagacgcatagatgagggtgagagcatttggcggtagcgcttgacgagcgacgagtaaaccctaatgctttgatcgcggcggcgtcgtttgagacactcccgaatcgatccgcctacatgcctatgaatcctcctcccccgccgcctcctgggtcggcgtcttcgacgccggcgggggccagctacttccctctccctttccacctgcagcagcaccagccgcagccgcagatgccgccgcctatggcggcgagcagctaccagcagtaccagcaacagctgcatcaggcgcatcagctcttccagcgggacgcgcagaccatcacccccgaggcgctgcagagcgtcaaggctgctctcgccaccagcgacgtcctcgaccccgccgccgccgcgaacgccaggccctccgatccctctaccagcaagaagcccatcccccgccgcgctgccggacaatcctgggaggatcctaccctcactgactggcctgaaaacgactaccggctgttctgtggagatctaggcaacgaagttaatgatgatgttctatccgaagcattctcacggttgtcatccttcagcatgccaagggttgtttgagataagacgactggcnagactaaaggatatggatttgtgagcttttcaaaacctactgacttggctgcagcaataaaagagatgaatggaaagtgtgttgggatccaccctatgaactcgcgctagagtaacggcaaggaaaaggaagatgttggagctctgcaaagacaaagaatcatgtcgaaaggag

SEQ ID NO: 89038 - protein, 119 aa, Zea mays
  misc_feature: Ceres CLONE 1576567
MAASSYQQYQQQLHQAHQLFQRDAQTITPEALQSVKAALATSDVLDPAAAANARPSDPSTSKKPIPRRAAGQSWEDPTLTDWPENDYRLFCGDLGNEVNDDVLSEAFSRLSSFSMPRVV

SEQ ID NO: 89039 - DNA, 1169 bp, Zea mays
  misc_feature: Ceres CLONE 1576569
  misc_feature: Encodes the peptide sequence at SEQ ID NO. 89040
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (874)..(874): n is a, c, t, g, unknown, or other
  misc_feature (973)..(973): n is a, c, t, g, unknown, or other
ggctttgccctggtggtagcgacggggaccccccccgagcagccataggagtgggtagtatcactaaatnngnngncaaaagtggagctcaccgcggtggcggccgctctagaactagtggatcccccgggctgcaggaattcgtctcacccctagaaaaaagcagtagtgcagcactgctactgcctccactccagtcccaggctcccatctcagagctctcagcggtggcggccggcgaccggcgagctcctccggcatcggatcccctggagtggagcgttgaaccacgctgcgggcctgcattcaccacctccgtgctttccttcgtcgtctccgcctcatctggttgctctggtcagcgatggccggtgacattacatgcagatccttgctgcaaaaattgcagtttatatggcatcatcttggagacagtgacgaggaccgtgacaaggtcctctaccatctggatcaagaatgactcccccccctacaagaggaaagttgaccaagcaactaactctagcggatctcctggatccaaggcgcctggatgactccaaagataagaaaccttgcctacggctgtctttgtcagctcctcgtgatgaaaaaaaggctcatttgccaaagaaacctcccttggaggaaagaacaaagcagggggaaacatattcaaaagaccaagccaaagctgtaggaccttggacgttaattaagtccgggctccataacccaccttttttaaagaccctcaaaattattggaaaacctctaaaaaaaccaagggataaaaagaaaaacaagtgggaaaaaaaatgcgcactgaagaaagacggagacgaaggtgtttattgagctctaaaaaagtggngttaacgcgaagattctcaccgagaaacactctgggcaatttccgaataattgaaactgagtggggcgatgggaaaaaaatctgcgccatttagggacngccccatactaaatatagattcgggaccttgcaaagaacaattaattgtaacgaatcatccccccccccaaggtcgcaaatgggagggaaattcgaccttttaaagcacctttgcacacaaggccgcttctaaaaaaattttttccacgtcgcccaagccataaagggcgaccctttggacaaatgaacaaaggag

SEQ ID NO: 89040 - protein, 38 aa, Zea mays
  misc_feature: Ceres CLONE 1576569
MAGDITCRSLLQKLQFIWHHLGDSDEDRDKVLYHLDQE

SEQ ID NO: 89041 - DNA, 975 bp, Zea mays
  misc_feature: Ceres CLONE 1576572
  misc_feature: Encodes the peptide sequence at SEQ ID NO. 89042
  misc_feature (818)..(818): n is a, c, t, g, unknown, or other
  misc_feature (871)..(871): n is a, c, t, g, unknown, or other
  misc_feature (930)..(930): n is a, c, t, g, unknown, or other
tccccgcggtggcggccgctctagaactagtggatcccccgggctgcaggaattcgtctcacccctagaaaaatctctttccagccacctcactcttcactagcctctgctcctgtgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaagggtgggagggatctgttcccgctgttacctgaggccttcaaaggaatcagacggatcgggtgtaaacggctggggctcgcaggggtccgcacaagctcaaaaattgaaagactcactggttaaaggcaatcccccaatattgctgcttagaatgggcttccggaaagggccccaaagtctttggaaagaagacccaagcatcatggattcccccaaaaaaaaatgaggacacctggggggaaaatttggggagaaagggttccgaacagtggaaactcgggcacgcttacggaaaaaccaaatttcggcccccgccggaaaaactggtgaaaaaatttttccccgacaacaacaagaaaaaagttttcccggggtgtggaaaaggagaatcttccggtggaaaataccccaaattgggggggntaagattccccaaagaaaaaaaaggtggtggggggaggatcccaacaggggancggcggcgccaccggtagaagatttttggctcctgtgacaaaaacacgaagggtgtgtntatagagaccctcccgccccccggcatgttagggagaagaaaaac

SEQ ID NO: 89042 - protein, 67 aa, Zea mays
  misc_feature: Ceres CLONE 1576572
  misc_feature: SWISSPROT Homolog: EC 1.1.1.86 Ketol-acid reductoisomerase
MPSLDFETSVFKKEKVSLAGHEEYIVKGGRDLFPLLPEAFKGIRRIGCKRLGLAGVRTSSKIERLTG

SEQ ID NO: 89043 - DNA, 824 bp, Zea mays
  misc_feature: Ceres CLONE 1576573
  misc_feature: Translation starting site: 136
  misc_feature (730)..(730): n is a, c, t, g, unknown, or other
  misc_feature (799)..(799): n is a, c, t, g, unknown, or other
  misc_feature (801)..(801): n is a, c, t, g, unknown, or other
  misc_feature (823)..(823): n is a, c, t, g, unknown, or other
ggagctccccgcggtggcggccgctctagaatagtggatcccccgggctgcaggaattcgtctcacccctagaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggcccacgtacctgggcgccccggtgcccgtgggcacgctgccgaccatcctggtgatcgagttcgtggccctcgccttccccgaacaccagcgcacatgggagatggaccccgagaaggaaaaagttccccgggcggcggcctttcgacccggttgggtttctcccaggaaccccgcccaagtttcgagggagtaacaagcctccaaggggagattnccagaagaaaggggggggccccctttcggccaaagggagggggggggggcggcgcctttttatgcgagngnggatgttttcttttatcggggna

SEQ ID NO: 89044 - DNA, 842 bp, Zea mays
  misc_feature: Ceres CLONE 1576574
  misc_feature: Encodes the peptide sequence at SEQ ID NO. 89045
gcggtggcggccgctctagaactagtggatcccccgggctgcaggaattcgtctcacccctagaaaaagcgaatccgttgccggtagcctctctgcggtgagagttctgctgccgcctgctggagatgatggacgacggaggaggaggggtgcagtcgcagggcgtcaacccggactgccccaacgccgccaaccccttccaccgctgcgccgcgtactgccccgtccccgccccggcccccaccaaagccgccgccgccgccgtgcgcagcaagccgtctccgcctcgtccgagggcgacggcggtggcggcgcagaacgggacagccaagcacggagacggcgctgcgcgtgtcgctcccgcctccgacgcggaggacgacgacgacgacggaggcgagagggaggagtcgcgggctgtcaactcgggctacccggcgtctccgcctcgtccggggccgaggccgacccacgcggcgcagaacgggaccgcgcgccgcgacgaggttgaggaggagtgcgagatcaccgtcgtcgacgagtcggaggagcacggcgagagcgtcgaggaccacggagggcaggagcaggagcaggaggtcagcggcggcggcaggacgagggcgagcgcccggtcgccgcccacggacgaacgggggggaagggccggcggaaaaaccccccgtgcaacgggcgggacaacccggaactgccccaacggccgcccaacctccttccaaccgctgcccccagagaactgcccccgtacccccgttcccccttgcctcaaaggtttccgctctctgttccgcgggtccaacgtgcgggttcccgaagggggc

SEQ ID NO: 89045 - protein, 239 aa, Zea mays
  misc_feature: Ceres CLONE 1576574
MMDDGGGGVQSQGVNPDCPNAANPFHRCAAYCPVPAPAPTKAAAAAVRSKPSPPRPRATAVAAQNGTAKHGDGAARVAPASDAEDDDDDGGEREESRAVNSGYPASPPRPGPRPTHAAQNGTARRDEVEEECEITVVDESEEHGESVEDHGGQEQEQEVSGGGRTRASARSPPTDERGGRAGGKTPRATGGTTRNCPNGRPTSFQPLPPENCPRTPVPPCLKGFRSLFRGSNVRVPEGG

SEQ ID NO: 89046 - DNA, 817 bp, Zea mays
  misc_feature: Ceres CLONE 1576576
  misc_feature: Encodes the peptide sequence at SEQ ID NO. 89047
  misc_feature (596)..(596): n is a, c, t, g, unknown, or other
ctccccgcggtggcggccgctctagaactagtggatcccccgggctgcaggaattcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttccctgacatcgaccagntcccccagttctggctccctggaagccttcccctcttcatcttcagggggttgggttccggacttcaccgggccccaaggggcggttcttttctggcctgggggggggtcccccccgggcttaaagtttaatggggtttttaggggcgtttaagaaaaaacccccctttggaaaaatccacttttttctcggaggggccccctggttttttttttggggcc

SEQ ID NO: 89047 - protein, 50 aa, Zea mays; identical to SEQ ID NO: 23071
  misc_feature: Ceres CLONE 1576576
  misc_feature (1)..(50): Pfam Name: AdoMetDC_leader Pfam Description: S-adenosyl-l-methionine decarboxylase leader peptide

SEQ ID NO: 89048 - DNA, 931 bp, Zea mays
  misc_feature: Ceres CLONE 1576577
  misc_feature: Encodes the peptide sequence at SEQ ID NO. 89049
  misc_feature (886)..(886): n is a, c, t, g, unknown, or other
ctggagctccccgcggtggcggccgctctagaactagtggatcccccgggctgcaggaattcgtctcacccctagaaaaagcctccctaaagatccgccgcttctctgccctctgctcgtcgattcggcgcctcctctccttcacgcgcccacgctgccgtcgcctcctcctcactgtcgtccatgccgctgtagccgcctacggccatggccgctggagccagcgactatttgacggtggagtaccactccagagagctcccctctttcctctccgacgacgagggagccaccgccggcagcggcgtcctcgtatgcagaacagcagaggacgctcgctcgctctgcgcgcatcgaaccaaaaaccacacctcggcggcagctatataaaagccttcacctgacccgggcgctagggtttattcgctcctcccacccgccgccgtcgccgcctcctctccccagcacccggagctcgctcgaccgccgctcaccatgatcatccccaagaagaaccgcaatgagatctgcaagtacctcttcaagggtatggtccactagactcgcagtacggtaacctgggctgattggttgtttcgccttctaggaggtgacagatcttcaaattattttcgtattactaggagggagtgctcgtgtattattttgagttcacttttttggctcaattgcagcatctcacaagcttacgatctgatatattattaggctcacacagcaagcattgtaatgagcatcttccgaggggaagctatcaaagcttgatacatagtgaacttaacttttgcgttgaatggaacaacagctcacaggaacaacaagcagcctgtactccccatataagctttcaagtcagatgaagccnttgaaaatttttggacaaccaggcacaggagttaggggagcttaa

SEQ ID NO: 89049 - protein, 60 aa, Zea mays; identical to SEQ ID NO: 88683
  misc_feature: Ceres CLONE 1576577

SEQ ID NO: 89050 - DNA, 815 bp, Zea mays
  misc_feature: Ceres CLONE 1576584
  misc_feature: Translation starting site: 266
tggagctccccgcggtggcggccgctctagaactagtggatcccccgggctgcaggaattcgtctcacccctagaaaaaaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtcgaggaggtgagccgcaactactacgaccgcgacgtctgccggctcttcctcgccggcctttgcccccacgacctcttccagctcacgaaaatggatcttggtccttgttctaagattcactcgcttcaactgcggaaagaaagcgaaagcaaagggaacagagaattttgacagagaactcgaggatatgatagaaaggctcattgtggagtgcgacaggaaaattcagagggccctgaaacgacttgcggatgacgatgccaaggctgctattgcgatatccgtctcggaggttactctgacggatgacatactgcagctgtcaaaacagatcaaggaaaaaatggtagaagttgatgcctttgattttgaagggagaactgatgataaaataaggccccagaagtagtggaagaactcagaactaaaagagctgatatgcaggctaccctcttgcttgatgctttttacaaggacagagcttcattaa

SEQ ID NO: 89051 - DNA, 2053 bp, Zea mays
  misc_feature: Ceres CLONE 1576586
  misc_feature: Encodes the peptide sequence at SEQ ID NO. 89052
aacacttgtccagccaccaccaccacttgttctttcccttcccttccttcgcctccgcttcctcctcctcctcctcctgcccctcccccacccccacccgtcgggacgcctccccactttcccctcccccggatccgcatggcgcctctgcagcccgcgccgctcggcctcccgtagccgacgcccggccccgtcccaccgcccgctgcgccgagcgctgcccgtcccaggctcatatttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcagatctcacggtgctgtccatgagctgcgtgatccagccccagtgatccagagcagttgctgggctaatttgccccctgaattgcttcgagatgtgattgagaggttggaggccagtgaagccacatggcctaacaggaagagtgtagtctcttgtgcagctgtttgtcggacctggagagaaatctgcaaagagatcgttaagaatccagagttctctggaaaaatcacttttcctgtgtccttaaagcagcctgggcctcgagatgtaaccatccagtgcttcatcaaaagggataaatctactcaaacctactacttgtatctgtgccttagcacagctgtgcttgttgaaagtggcaagttcctcctatgtgcgaaacggacctcccgcccaacctgtacagaatatacaatatttatgaattctgaaaatttatctaggtcaagcaaaatgtacattggaaagctgaggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtcttgggtactcggggccctaggcggatgaactgtgttatgcactccatccctacctcgtgccttgaggctggtggcagtgttcccagccagctggacagcatccttgctcgctccactgatgagtcatttggcagcatttccttctccaaatcatctgttgtggaccggtctatgcgtttcagcagctcaagattctccgacatctcaatgagcagcagccgcaggattggagacacggcatcgggagacaatgatgagtgcaaggagaggccattgattctccggaacaaggccccaaggtggcacgagcagctgcagtgctggtgcctcaatttcaggggcagagtgacagtcgcatctgtcaagaacttccagctcgttgctgccacgcagcccgctgctggagcaccaaccccatcacaggctaccccagtgccgccgccggagcacgaaaaggtgatcctgcaatttgggaaggtggctaaggacatgttcaccatggactaccgttacccactgtcagccttccaggccttcgcgatctgcctgagcagcttcgacaccaagctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctacctaagagctctgtctgcctttgccctctgggatatgcaaatgtgcatcttgtaaaatttctgaattgcttttgtggcaagtcatagtaataaaagaactagcttccaaaaaaaaaaaaaaaa

SEQ ID NO: 89052 - protein, 437 aa, Zea mays
  misc_feature: Ceres CLONE 1576586
  misc_feature (117)..(431): Pfam Name: Tub Pfam Description: Tub family
  misc_feature (51)..(106): Pfam Name: F-box Pfam Description: F-box domain
MSFRSIVRDVRDGFGSLSRRGFEVKFLGHRRGRSHGAVHELRDPAPVIQSSCWANLPPELLRDVIERLEASEATWPNRKSVVSCAAVCRTWREICKEIVKNPEFSGKITFPVSLKQPGPRDVTIQCFIKRDKSTQTYYLYLCLSTAVLVESGKFLLCAKRTSRPTCTEYTIFMNSENLSRSSKMYIGKLRSNLLGTKFAIYDTQPPCNAAEPGKTSRRFYSRKVSPKVSSSTYNIAQVSYELNVLGTRGPRRMNCVMHSIPTSCLEAGGSVPSQLDSILARSTDESFGSISFSKSSVVDRSMRFSSSRFSDISMSSSRRIGDTASGDNDECKERPLILRNKAPRWHEQLQCWCLNFRGRVTVASVKNFQLVAATQPAAGAPTPSQATPVPPPEHEKVILQFGKVAKDMFTMDYRYPLSAFQAFAICLSSFDTKLACE

SEQ ID NO: 89053 - DNA, 804 bp, Zea mays
  misc_feature: Ceres CLONE 1576587
  misc_feature: Encodes the peptide sequence at SEQ ID NO. 89054
ctggagctccccgcggtggcggccgctctagaactagtggatcccccgggctgcaggaattcgtctcacccctagaaaaagcgcctccacagtccacactcaccgcgtctcattttgttctgcgttcttccgctcgccccctcacaacgaaacctagagagtcccgcgcgtgacatggcggacggcgcgggctcggcgtctggtctggtggagaagctcgcggagctttcaacgggcagcgccgggcagaatcctccgccggcgggtgaaggcggagaggagctgcagctctcgaagaacgcgaagaagagagaggagaagaggaagaagctggaagaggagcggaggctcaaggagggaagagaaaaaagacaaggctgctgcctgctgctagttggaaagccctcagaaaggcatctgcctgctgaacgaatgaatgaccttggatccccccctcaattactaccaagaaattggggcccaggaaccccttggtttcccccccagggcccccaggggggtaaaccccccttccccccaaaaaattttccccggtggggggccctccccggggggggagaaaacccctttggaaaaaaaacaaaaaacccctttaagaaaaacgggggggaaaaaaactttttcaaatttggcggcccaaaaaaatttttgttttcggggggggggggggttcttttaaaaaaaaaaaaaaaaaaaccccccccccccccgaaagaagatttattttctttttttataaaaaacctccttttatggggggggggggggcggcgcagaaaaaaa

SEQ ID NO: 89054 - protein, 210 aa, Zea mays
  misc_feature: Ceres CLONE 1576587
MADGAGSASGLVEKLAELSTGSAGQNPPPAGEGGEELQLSKNAKKREEKRKKLEEERRLKEGREKRQGCCLLLVGKPSERHLPAERMNDLGSPPQLLPRNWGPGTPWFPPQGPQGGKPPFPPKNFPRWGALPGGGENPFGKKTKNPFKKNGGEKNFFKFGGPKKFLFSGGGGVLLKKKKKKPPPPPKEDLFSFFIKNLLLWGGGGRRRKK

SEQ ID NO: 89055 - DNA, 982 bp, Zea mays
  misc_feature: Ceres CLONE 1576592
  misc_feature: Encodes the peptide sequence at SEQ ID NO. 89056
ctggagctccccgcggtggcggccgctctagaactagtggatcccccgggctgcaggaattcgtctcacccctagaaaaaaaaagggtggaggtggaagccgcaaaccaaaccctctctgcctcgtcctccctcctgcttcgtgcttccccttccccgtctcgtctgcggcgccaagctcgagctcatcgccaccgaggtacgcatctctcccccgaagaactccgagctctaatctctcaccacaatccccgaatttctgattttctggtatgtttatttattctgatttttttgcgcgcaaggtcgtttcgatctgggttgtagcctatccgcgaggaacgtaaattagttggagacttcgtgatggctgctgcgaagtcgggcgtagacgtgaaaaccaaggacggcggcggcggctccttcaacgaggagaggtttgttgataagctcaacaagctcagcaacacaacagcgagcattaagacactttcacattggtgcatttttcaccgcacgagggccagaaggattgtggacacatgggaaaagaatttcagtactgccacaaatgataaagaaaatatcattcctgtctctatcaaatggatatcttgccaaacaggaagcgcaaggggaggagattatgtgcatgaactctgggagggttctacccagattatttgaaacatttctacgataaagcggggagaagaaaccaagaaaacggggggcaagaataattagaaatttgggatgcacgcgaaagttgttggaacccgtattggaagtctgaaaaacggaattttttggggaacaacctcctgtactcctaccaagggggaaatattaataattcaaattcctagccccaacccctttaattccaaagtttgggatggtaagatctcggtcccgtactaataacaactgaactgttggtgggtatgcctcaaataatgtggatcgcgataccaaactgg

SEQ ID NO: 89056 - protein, 106 aa, Zea mays
  misc_feature: Ceres CLONE 1576592
MAAAKSGVDVKTKDGGGGSFNEERFVDKLNKLSNTTASIKTLSHWCIFHRTRARRIVDTWEKNFSTATNDKENIIPVSIKWISCQTGSARGGDYVHELWEGSTQII

SEQ ID NO: 89057 - DNA, 878 bp, Zea mays
  misc_feature: Ceres CLONE 1576593
  misc_feature: Encodes the peptide sequence at SEQ ID NO. 89058
aaagctggagctccccgcggtggcggccgctcttcaactagtggatcccccgggctgcatgaattcgtctcacccctagaaaaaaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagcaatggagcggcggcggcggcggccaccgaggctgccgctccttgtgttcgtcttagttgccaccacttgccccctcgggagctcagcagggattggaagcttcggagtcggtgcggagagcaatggagcttcgtctagttttaggaacaggagtctgctgcagattggagacagaaacgaagatgggcctattcatctgccacatacacgggctctcacgcacaagagcagatctcatagaaaagtttcaaacacccgcaccagcaccaagagtccgctccagcaccctcaacatccatgttttcaccggaaaagcttaacggtttccgtaaccaaattggtttccaccccaaggccaccgccaataaaatttcaaattggcaatccattccaaaaaccctccaaatttgggccaggccctggggcttggcaaaaagggaaaaaaaccccttgggtttaaaaccccccggtcaattttcggggaaaaaaaattttttggaaaaccctatgggttttaatttccaccggaggaattgggggtttttcctttgtggaaaaaacaaccaccaatattttttccctcttcccgcgtcaaaaaaaaaagggagaccccttagggcgcctgggggcaaaaaaagtttta

SEQ ID NO: 89058 - protein, 152 aa, Zea mays
  misc_feature: Ceres CLONE 1576593
MERRRRRPPRLPLLVFVLVATTCPLGSSAGIGSFGVGAESNGASSSFRNRSLLQIGDRNEDGPIHLPHTRALTHKSRSHRKVSNTRTSTKSPLQHPQHPCFHRKSLTVSVTKLVSTPRPPPIKFQIGNPFQKPSKFGPGPGAWQKGKKTPWV

SEQ ID NO: 89059 - DNA, 1022 bp, Zea mays
  misc_feature: Ceres CLONE 1576594
  misc_feature: Encodes the peptide sequence at SEQ ID NO. 89060
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (991)..(991): n is a, c, t, g, unknown, or other
tttttttgtgtggttggtggcttctaccagcacctggggcgtagcgtgggggttagtgatnnnaaaaggcccctcttaaaaactgggactccccgcggtggcggccgctctagaactagtggatcccccgggctgcaggaattcgtctcacccctagaaaaaaaaccaaaggaaccgatcagagagagagagagagcgcatagtcgatcatgaagggtggcaagaaggaagtggccggtgcggtggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacatgcatgcgccggccgacgacgacgctgcctctcgtgagcttctgttcaagggatggcatggtttcaaggcattccatgggatgcttttatggcataggaatatgccgtattatttaaattaagccggtgttcaggggaaccccgggcaaaaagggggggggggttggttctttatttataccacaccttcccggggggggacctccagttaaaaacggggcaaaaaaactattggtttgggaattgcgggtgtgcaaatggcaaaaagaaaaatttttatattgggctccggccccctggaccctgttaaaagggggtttggctataaaagagcccctttctataatggttgtcccgaagttatagaaagaaacaaaaaaaaaacttcgaaaaccaaaacatccatgagcccggggacccataggcgccgtgcccccttgtttttgaggcaaaaagggccataccccaagctcgggggangaacctcgcgataagaacttaagccttatga

SEQ ID NO: 89060 - protein, 90 aa, Zea mays
  misc_feature: Ceres CLONE 1576594
MKGGKKEVAGAVVAILLVLQLMAAPPTAMAARSPHGAVPDGSLATTPKVTMLSATLCYTGETCKYIGCLTPACSCNYSDRLCYIIFTPVA

SEQ ID NO: 89061 - DNA, 1223 bp, Zea mays
  misc_feature: Ceres CLONE 1576599
  misc_feature: Encodes the peptide sequence at SEQ ID NO. 89062
gtggaatttagttttttcttacaccgacccccccccggctcactctaccctctaaaaactggccgcgttcccaccggtggggctccccgcggtggcggccgctctagaactagtggatcccccgggctgcaggaattcgtctcacccctagaaaaagttcccactcattaagataccaccgcctcccgccgcccgccgcccgccgccgacgagcaccgcagcctgacacagagccgcgggcgagccatcgcgtgcggcctcgcccgggatggcgaccatggagagcctgatcgggctggtgaaccggatccagcgcgcgtgcaccgtcctcggcgaccacggcggcggcggcggtgagggctccctctgggaggcgctcccctccgtcgctgtcgttggcgggcagagttccgggaagtcgtcggtgcttgagagcatagtagggagggacttcctgccccgtggatctggtatcgtcacgaggcggccttatagtgctgcagctccacaaagacagatgggtgggcacgagtatggcgtgaagtttctccacgccccggtggaagccgggttcacccaacttttgcctgctggagagggaaaaggagattggctcaatgaaaaacagaaccgcgcatttactgggggagaaaaccttaaaaggcttaatttttcaaaatgggtttcccccattccccacattttgtaaagtgattattaatctccggccccacaactggtgtggcgaattaaaactcttgggagccacccgtaacatattgggagagtgacgttatacccgcgtgggaaaagcttggtaaacccaaaaaaagaggtattcgcgttattagttaaagtaagaagggcgcgcgcaaaagggtcgcgggaaagatcctgatacatttgggttattctgcgagatgactaagtttttgctaacgaaaaccattgggggcatttgcgagatttattgttatttgggggggagagcacaaaaagtgcaaaagaaattggagctactctcttttctgatggggggagaaatgagttttcccccgcgcggttcctaaaccacagtatagatatataaagctaaaatgcgggcccgtagaaagttcttacttccgtagactttttgcctcctgcggggggatgtgtccagaaatcgtcatttcttgcggtgtgaacaacggaaccattctttggagagagaatgtataaaa

SEQ ID NO: 89062 - protein, 146 aa, Zea mays
  misc_feature: Ceres CLONE 1576599
  misc_feature (40)..(146): Pfam Name: Dynamin_N Pfam Description: Dynamin family
  misc_feature: SWISSPROT Homolog: EC 3.6.5.5 Dynamin GTPase
MATMESLIGLVNRIQRACTVLGDHGGGGGEGSLWEALPSVAVVGGQSSGKSSVLESIVGRDFLPRGSGIVTRRPYSAAAPQRQMGGHEYGVKFLHAPVEAGFTQLLPAGEGKGDWLNEKQNRAFTGGENLKRLNFSKWVSPIPHIL

SEQ ID NO: 89063 - DNA, 750 bp, Zea mays
  misc_feature: Ceres CLONE 1576600
  misc_feature: Encodes the peptide sequence at SEQ ID NO. 89064
ctcaccgcggtggcggccgctctagaactagtggatcccccgggctgcaggaattcgtctcacccctagaaaaagccgcagccagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccgactcctccatactctccccctacatcgccgcgccggacgacatcgcgcgagccttcggcgcccccgcctccgagctcccgccgctccccagcgccgaccccagccctgggctatgttgcacgggcaccgaccagccgctggcggcagtcgcggacctggccgcaactgccgtggtcaactcggctcccaccgacgccgcggagcgggccctgtcggacgcgccgttccccagcacggttcccgtctgacgcgtccgaggtccgaggactccgggggccaggcctcatcgataaagggcggcaaagcagggtcttcccaggcgggaggacgcgctcacccgggggcttatcaaacaagctggagggctgtcc

SEQ ID NO: 89064 - protein, 137 aa, Zea mays
  misc_feature: Ceres CLONE 1576600
MLLPVCSAAPSCSPLCPVTASHVVARVARRVDVGAALRSYADSLVAQVPDRPPLADSSILSPYIAAPDDIARAFGAPASELPPLPSADPSPGLCCTGTDQPLAAVADLAATAVVNSAPTDAAERALSDAPFPSTVPV

SEQ ID NO: 89065 - DNA, 932 bp, Zea mays
  misc_feature: Ceres CLONE 1576602
  misc_feature: Encodes the peptide sequence at SEQ ID NO. 89066
  misc_feature (932)..(932): n is a, c, t, g, unknown, or other
ctccccgcggtggcggccgctctagaactagtggatcccccgggctgcaggaattcgtctcacccctagaaaaaaacgagcgtatctgctttttttttttttggtaaaagaatttgtttttgcaaagctagctcctacgctgccgccgccatgcaccgcttcgccgccgacagggcgcgccgcgcggtggccgcgtccctgcgcggcgcagcttccagagcagcagcagcgccgtcgcgtcacgctccggcgcctcgccatccaacctccccagtcggggcggcggcgccggttgctgccgccgccatggcgagggccgccatgtccacggcggtcgcgggcgtgccaccaccggtgtcgctcgacaccatcagccccaaggtgccgccagtgtcgctcgacaccatcaaccccaaggtcttgaagtgtcaatttgcagtccggggagagattgtcacacgtgctcagaaactgcaacaagaactgcagagaaatccagagtcgcttccttttgatgagatactctactgtaacattggaaatccccattccattggccaacagccagttacctatttcagagaagttctatctttatgtgagaatccagctctcctggacaaaagtgaaacgcatgctttatacaggtcagatgctatagagagagcacggaaaattctagacaaaataccaggaagagctacaggagcatatagccacagtcagggtataaaaagtttacgtgatgaaaatgctgccggaaatgctgcccgagattggtttcattgcagcgcagatacatcttccctacagatggagcagcccagcagtacactgattcttgcagtattgatagggtcgagtaagatggcattctttgtccattcacagtaacattgtactcggcatcattgcctctcatggtggtcccn

SEQ ID NO: 89066 - protein, 195 aa, Zea mays
  misc_feature: Ceres CLONE 1576602
  misc_feature: SWISSPROT Homolog: EC 2.6.1.2 Alanine transaminase
MARAAMSTAVAGVPPPVSLDTISPKVPPVSLDTINPKVLKCQFAVRGEIVTRAQKLQQELQRNPESLPFDEILYCNIGNPHSIGQQPVTYFREVLSLCENPALLDKSETHALYRSDAIERARKILDKIPGRATGAYSHSQGIKSLRDENAAGNAARDWFHCSADTSSLQMEQPSSTLILAVLIGSSKMAFFVHSQ

SEQ ID NO: 89067 - DNA, 711 bp, Zea mays
  misc_feature: Ceres CLONE 1576603
  misc_feature: Encodes the peptide sequence at SEQ ID NO. 89068
  misc_feature (402)..(402): n is a, c, t, g, unknown, or other
  misc_feature (467)..(467): n is a, c, t, g, unknown, or other
  misc_feature (474)..(474): n is a, c, t, g, unknown, or other
  misc_feature (475)..(475): n is a, c, t, g, unknown, or other
ctggagctccccgcggtggcggccgctctagaactagtggatcccccgggctgcaggaattcgtctcacccctagaaaaactgcccactgctcagtccactgcccagcacggatctcatctcaccagctgcccgcgcatccaattcctctcgctggacggctgcagcacatcatcaggtgagaccgtgagagggaatgggatcaacaacaatgtcccctccagtatcttattgacaactccgacgacatccccaccaacgatcccgacgggtggcctgagggagactacgacgacgacgaccttctcttccaagatcaggaccaggacctcacaggccaccagccggagatcgacgagacccacgtcgtggtcctcgccgccgcaaacttttcctccttccntcgccctcagccacccatgtatggtgagtctacgcacctggtgtggccactgcagagctcgcccngatacgnncgcgcgcgggcatttgcccgtcaccacacaggccacccggccttgcaaggtcgacgcaccgagaaaacgacctgcccagagtaccacttcagggtttcccaccatctctttttattgagggggtccccgagggctaaacggaccccgacccaagaaagccttcttcaaggggttaaacaaaaagcttcggcccaccccggtgaaaatgttcccccgaggttaaaaaaaagccccaa

SEQ ID NO: 89068 - protein, 56 aa, Zea mays
  misc_feature: Ceres CLONE 1576603
  misc_feature (18)..(18): Xaa is any aa, unknown, or other
MVSLRTWCGHCRARPDTXARGHLPVTTQATRPCKVDAPRKRPAQSTTSGFPTISFY

SEQ ID NO: 89069 - DNA, 842 bp, Zea mays
  misc_feature: Ceres CLONE 1576604
  misc_feature: Encodes the peptide sequence at SEQ ID NO. 89070
  misc_feature (531)..(531): n is a, c, t, g, unknown, or other
ctccccgcggtggcggccgctctagaactagtggatcccccgggctgcaggaattcgtctcacccctagaaaaagtcctgcgttccattccaccctcctccgtctccgatcctcgccttcaactccactccctcgctctctcgggccttcttccctagcggcgacgacggggtgatcactgattcactgccgcccgcgccaggtcggccagaactagtgggcgccaaacatcatagcgatcatggaggtggtctcttgcagccactcctgctcggcattacatcaaacaccagcaagcacatggaggcttcggggcagtgctcttggccttggtcttgggcatgccaggccttcccggaccagaagatacacagttgcgtgtgtaggaaccacgagtggagcttcgaatccgggtggttccggcaaggtccatgcagcccagggattccatgtaagcgacgtggatgcagccctgcagggcattccttccatgaaagccggggaggccgagagggtgatgattcaaggccnttccggaaggccctgacagctccccgatcagtactgggttctggggagtggaagccgaagctgactgtgtactacgagaggtcccgcatgaagaacagcaagggcacctgcggtgctcttcctgccgggggttcggagtcggaaccttccattttcgagaaagcaactgaagggatctttggtcgccgatcatcggggggtggaaccaagggatttttctccggggcagggggatggtccccttgcccgggtggaaaaattcctgcctccctaggttacctttaaccgagcccgcaaaaatgtcttttttt

SEQ ID NO: 89070 - protein, 171 aa, Zea mays
  misc_feature: Ceres CLONE 1576604
MEASGQCSWPWSWACQAFPDQKIHSCVCRNHEWSFESGWFRQGPCSPGIPCKRRGCSPAGHSFHESRGGREGDDSRPFRKALTAPRSVLGSGEWKPKLTVYYERSRMKNSKGTCGALPAGGSESEPSIFEKATEGIFGRRSSGGGTKGFFSGAGGWSPCPGGKIPASLGYL

SEQ ID NO: 89071 - DNA, 1072 bp, Zea mays
  misc_feature: Ceres CLONE 1576608
  misc_feature: Encodes the peptide sequence at SEQ ID NO. 89072
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (61)..(61): n is a, c, t, g, unknown, or other
ggttgttgtctcttctccataaatgtccgcctgtctattaccttttctttnntnttttttnttttcaaactggagctccccgcggtggcggccgctctagaactagtggatcccccgggctgcatgaattcgtctcacccctagaaaaaaatcgcgccggcgcctctgttctgctcgcttctagatcttgcggccgacttgccgagccaagggctcggcgccgacgccggcgccttccctgttctccggcgcggcttacgggaggctgtgcgtattgcaggcctccttcctcacgtttctggaggaggtcccagacgtgtcagtgaccatgaccgcacctctgccatcatcgggggtgctggggctcacggagctgcacctggccatgcagaagctgcgtttactcctcacggactgctggcgacagggggagcaaatatacttgctccccaacggcggattgggcgcgtctgaactccgagtgattcacggggccgtcgctgcggccttggacccgctgccgaatgacgttgtggactcctccctggaggccgggtagctcgcgcgtgtcatgtccggaacctgcttagccgaggcgcagagcgttacggatagccatcgacctatgcctctcggccaagtagcgtggctgccgaatactgggagcaagttcctatagccgtgcgtctcggcactgaactctcctactgactcccagagcgtgttgtctagtaagcaactatctgggggtgtaagaaatgcgttttccctaagtgcctcccgagagaaatttggcgccttcccttttaagaaactaaccagccgcccccgcgcgtttgggtacgggcgtctattgcggagtatcaagcctgggctcccacaccggggtgcaatcttctacccacgttttaatgtgcatatccgcggagggggacctttccccggaccattactggatttcatcactggcccttgacacctttgtccgataatactgtaacacagctcgttcgacttgcactcgttgaagagctgccctgggcaactggcctgtaaaacaccttattttgtt

SEQ ID NO: 89072 - protein, 76 aa, Zea mays
  misc_feature: Ceres CLONE 1576608
MTAPLPSSGVLGLTELHLAMQKLRLLLTDCWRQGEQIYLLPNGGLGASELRVIHGAVAAALDPLPNDVVDSSLEAG

SEQ ID NO: 89073 - DNA, 837 bp, Zea mays
  misc_feature: Ceres CLONE 1576610
  misc_feature: Encodes the peptide sequence at SEQ ID NO. 89074
ctccccgcggtggcggccgctctagaactagtggatcccccgggctgcaggaattcgtctcacccctagaaaaaaggaggagaggaacggagagctggaaaaagcaggaaagacccggcttttgaccccaagtaccctgttgagggcaatggctgccacctccgaggaggcaatcaagcaattctcggcgctcatggagcatctagaggatcctctaaaaagcacattccacaatgtgcatcaaggaaatctgagagggactttgatgcgttttctgaacgctagagaatggagtgtgcctaaagcttataaaatgctaatggattgcttaaactggagagtacagaatgagattgacatcgtgttagctaaacccattctgccatctgatatatatagagttattcgggacacgttacttgttggattgacatgctactcctagcgagcacaacctatttatgcatctggtgtgcgtcttagtactttcgacaagacctctgtgaactactatgtgcaatctcacatacacatgaaagaatctcgagatcgtgttgtcctgccctctgcatcatataactttgcgagacggatcaatacctggctgcatgctatgaatatgactggcctcaagctctctgcgctgagcctaatcaagatgatgaccatcattactactgattatgaccttcaattatcctgagcaaacggaaacctttctacggtggcaaatggccccaatttttcttctcagcgcgttggaaaagattttgaaaccccactctttcctggtaaggaacctcagacggaggatcccaagccctgtaaggggcctcg

SEQ ID NO: 89074 - protein, 98 aa, Zea mays
  misc_feature: Ceres CLONE 1576610
  misc_feature (2)..(69): Pfam Name: CRAL_TRIO_N Pfam Description: CRAL/TRIO, N-terminus
MAATSEEAIKQFSALMEHLEDPLKSTFHNVHQGNLRGTLMRFLNAREWSVPKAYKMLMDCLNWRVQNEIDIVLAKPILPSDIYRVIRDTLLVGLTCYS

SEQ ID NO: 89075 - DNA, 1088 bp, Zea mays
  misc_feature: Ceres CLONE 1576613
  misc_feature: Encodes the peptide sequence at SEQ ID NO. 89076
  misc_feature (58)..(58): n is a, c, t, g, unknown, or other
tttttgttgccccttccttgtgagagttaatccactcaaaatgtataaattttttttnttttttaaactgggactccccgcggtggcggccgctctagaatagtggatcccccgggctgcaggaattcgtctcacccctagaaaaaactacgatacgcggggatgcatagacgtcggcaggaggagctcatgtcgaacaccaatagcgttagccaccaccagtagccacagcagtcatggggtcggtgccgcctgcagagggggacaggcgccagccccagcagcagccacacgtggtgatgatcccgtacccggcgcagggccatgtcacgccgatgctgcagctggccaagctactccacacacgcggattccacgtcaccttcgtcaacaacgagttcaaccaccgtcgccacctgcgcgcgtgggggccgggcgcgctccacggcgcgccggggttccgctccacccccattgacgacggccttccgccctccgacgccgacgccacccaggacgtccccaagctctgatactccaccatgaccacctgcctaccccggttcaggggacctaattgggaggaccaatgccgaggacgacgcccagggacgccccgccgtgacgtgcgtcgactccgacagcatcatgagcttcggcctccgcgccccgcgggtagctcaggtctccgctgcgccaagtttttggaaccaccagcgccggcgggctaaatggggctcctcctacttaccgcccccctttgccggacggggtttcggcccggctttaataatggaagggcagctcacccgacagtttccttgagacaccggtcctgctgactggtatcccctttccgcgcccaaaagaacctggaatctcccgggactttcccgaagcttttgggggcacccctctgtaaccctgacggaaatgaatgccctcaaattgtcgcattcacactaaggttataaggcggaatgcgccacaaggtatccgtttgttggatcataaaacacccttacagattaataggaaaggggagcattgtgctctccgcacatagggggaaaatctctcctgcttcc

SEQ ID NO: 89076 - protein, 98 aa, Zea mays
  misc_feature: Ceres CLONE 1576613
  misc_feature: SWISSPROT Homolog: EC 2.4.1.121 Indole-3-acetate beta-glucosyltransferase
MGSVPPAEGDRRQPQQQPHVVMIPYPAQGHVTPMLQLAKLLHTRGFHVTFVNNEFNHRRHLRAWGPGALHGAPGFRSTPIDDGLPPSDADATQDVPKL

SEQ ID NO: 89077 - DNA, 918 bp, Zea mays
  misc_feature: Ceres CLONE 1576614
  misc_feature: Encodes the peptide sequence at SEQ ID NO. 89078
ctccccgcggtggcggccgctctagaactagtggatcccccgggctgcaggaattcgtctcacccctagaaaaagcgctgcttcgctgtctttcggcaacgccctttaccacatctgaatctcacccacccacccccgcgccccccgccaaagcatggcgccggcgatggggatgaagcggcctgcggctgcggcggcggcggcgggagcgggggcagcagcagcgcagacggtcacgctgtccgcgccggccgtgcgggacgcggtgcgcgccgccgtgagggatgccgaggccaccgccccggccgccagggtcccggcgacggcggcagccacggcggagatcgctagggacggggtgctgtgcctggaggaggtcgacgggaggcggtggagctacgtggtcgacgccgccggcgccgcggtcaaggctaagggaagggcgtccgtcggcgccgcccttcagagtcgtcccgctccagtccccggctgccgccccgtcgaggaaaatattgtcctttaaaaagaacatatgtttgtggccccaaagggctttcccgaaaaaggggcccccccctttcataatggttccataccctggacatggggagaaggcatttgaaaagcctttttctttttgggggggaaccaaatgggggcggggttttaaaaaaaaaaaaacccttggctcaaaacttcgggttgggaaggtctccccaaaaaaaagggggcggccctctcgggggggcggggggggcataccaaccgggggaaatcctcaaaaaattaggggcctcgggcccttttttaaaaaaaaaaattcttttttttcccccccccagggggagaaaaatatttgtttttgtggccccgtgaggaacgctttccctttttttggggggggagctcccggggggg

SEQ ID NO: 89078 - protein, 122 aa, Zea mays
  misc_feature: Ceres CLONE 1576614
MAPAMGMKRPAAAAAAAGAGAAAAQTVTLSAPAVRDAVRAAVRDAEATAPAARVPATAAATAEIARDGVLCLEEVDGRRWSYVVDAAGAAVKAKGRASVGAALQSRPAPVPGCRPVEENIVL

SEQ ID NO: 89079 - DNA, 844 bp, Zea mays
  misc_feature: Ceres CLONE 1576616
  misc_feature: Encodes the peptide sequence at SEQ ID NO. 89080
ggccgctctagaactagtggatcccccgggctgcaggaattcgtctcacccctagaaaaagcgtgagatctcaccttcgcctatctgttcatcgtccccccttggtcctcctccccgaccccgacgtgcgacatgaacgggaagcagagcccgcgcaatggccgaactgcgtaccacttccagcctgccaagaactggatgaacgacccaaatgggcctctgtaccacaagggcatgtaccacatgttcgtccagtacaacccgcacggcccgacgttcggcaccgggaagctctcctggggccactccgtctccggcgacctggtgaactgggcgttcctgggcaccgcgctggacccgacgtcgccggttggacgccgagggcccctggtcgggctccgccaacagggtggccccaccgccgccccgccatcctctacacccgggcgcgacgcaaagcgggcgggcaggtggcaaaaacgtgggcgttcccccaaagaaccccggtcggaccccactggcttccggggagggggcggcagagccccccccggcttgcgaaccacgggtgggtcccgcaagcccggggcgaacgatgaccgggccaaaaaactttcgccgggagccccccccccaccggccttgggccttggggcggcaaaccaggcctgtccggccagtttcctcacgtccccgcacccaaaggtccagcccgcctggggggcacccaccccccgggggggtccccggaacacgaaggaaacattctgtggccccatgtggaagagggggggttccctgtgcccaccttaacccgcgcgtgccctcccgagaaacgaacacg

SEQ ID NO: 89080 - protein, 226 aa, Zea mays
  misc_feature: Ceres CLONE 1576616
  misc_feature (15)..(225): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MNGKQSPRNGRTAYHFQPAKNWMNDPNGPLYHKGMYHMFVQYNPHGPTFGTGKLSWGHSVSGDLVNWAFLGTALDPTSPVGRRGPLVGLRQQGGPTAAPPSSTPGRDAKRAGRWQKRGRSPKEPRSDPTGFRGGGGRAPPGLRTTGGSRKPGANDDRAKKLSPGAPPPPALGLGAANQACPASFLTSPHPKVQPAWGAPTPRGGPRNTKETFCGPMWKRGGSLCPP

SEQ ID NO: 89081 - DNA, 975 bp, Zea mays
  misc_feature: Ceres CLONE 1576618
  misc_feature: Encodes the peptide sequence at SEQ ID NO. 89082
  misc_feature (832)..(832): n is a, c, t, g, unknown, or other
  misc_feature (975)..(975): n is a, c, t, g, unknown, or other
ctccccgcggtggcggccgctctagaactagtggatcccccgggctgcaggaattcgtctcacccctagaaaaagggaccgacgggcgagagagcggaagcgacgactagctctgcggcctctgccccaagcgccgacgatgggtgccggtgctactgccagggacgaggaggctgctaccggccaccaccatgggaggaagccgcatggcgcagcggcggagtacgcgcaggacgggtccgtggacctgcgcggcaaccccgtgctccgctcccagcgcggcggctggaccgcctgctccttcatcgtcgtgtacgagctgttcgagcggatggcctactacgggatctcgtgcaacctcatcatctacctgacagacaagctccaccagggcagcgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccatctcggtgccggcgctgaagccgccgccgtgcggcgcccgcggcgtgtgcccccaggcgtcggcgctgcagctcggggcgtacttcggcgggatctacatcgtggccctgggcaacggcggcaccaagcccaacacctccaccatccgggcgggacagttccaccaagttccaccccccggaagcggacgcacaagctgtccttcttcaaccgggggggatgttcaccatcctcctggggatatctccttccccttcaccggtctgcgtctacctgtntttttcgaagtgagcctggttccgtgaggcttatggaattccccacggctgaggcctcaagggttttcatcctccggtctttcttcgttcgggacctggagtggtccctccaccaggtgtgccgtagggtgataccccggtcn

SEQ ID NO: 89082 - protein, 239 aa, Zea mays
  misc_feature: Ceres CLONE 1576618
MGAGATARDEEAATGHHHGRKPHGAAAEYAQDGSVDLRGNPVLRSQRGGWTACSFIVVYELFERMAYYGISCNLIIYLTDKLHQGSVEASNNVTNWSGTVFLTPLLGAYVADAYLGRYWTFVVGSAIYLLGMVLLVLSISVPALKPPPCGARGVCPQASALQLGAYFGGIYIVALGNGGTKPNTSTIRAGQFHQVPPPGSGRTSCPSSTGGDVHHPPGDISFPFTGLRLPVFFEVSLVP

SEQ ID NO: 89083 - DNA, 803 bp, Zea mays
  misc_feature: Ceres CLONE 1576620
  misc_feature: Encodes the peptide sequence at SEQ ID NO. 89084
ctggagctccccgcggtggcggccgctctagaactagtggatcccccgggctgcaggaattcgtctcacccctagaaaaagccaacggcgccacggcggcgacgagaagtggcgagccccgagagcgggtttagttagaggctacgggcggtcgggcgcggcggcggcggcagccatgagcagcgggagcgagagcactaccgccagcaggtggcccgagctggccacgctgcgcgcgctggcgcgcgacgccgcggagcaacttcggctgccgcgggccggcacgtcggcgtcggcgtcatcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgcgatccgccccgcacggactgtactgtacctatatactacacctacatactacgacgtgcacctgtactacgacgtgctgctgtaccatactaaatactagtgcgctgctgctcccttgccttagagagagtgactgcgagcacaagaccccacgccggccaccggccaccgccgcgagaagaactgaccgactaccgagcatgaatgccaggcctccgcacgtggccatgctgtccacgcccgtgcatgggccacctgatcccgctagcggatctggccaaactcctggcggcaacgacacggtgccaacgacacgctcatcaccttcgccgtcagcgcgtcggacacccc

SEQ ID NO: 89084 - protein, 70 aa, Zea mays; identical to SEQ ID NO: 55415
  misc_feature: Ceres CLONE 1576620

SEQ ID NO: 89085 - DNA, 894 bp, Zea mays
  misc_feature: Ceres CLONE 1576621
  misc_feature: Translation starting site: 106
  misc_feature: SWISSPROT Homolog: EC 2.7.11.1 Non-specific serine/threonine protein kinase
aaactggagctccccgcggtggcggccgctcttcaatagtggatcccccgggctgcaggaattcgtctcacccctagaaaaaaaaaaggtcgggaaaaatccgaaatggccgctagtggcctcggtctctccaactccttcctccccggccacaacaccctcctccagcgccggcaccggcggccggcgggccacaccgccgtgtcgttccggccggtgactgcggagctcggcggcgtccctacagagctgggcccccacctggcggaagcagtgggcgtggggctcccctgcaccgtcatgcaatgaggcaacttcatataccgcaccacgctcccccggaacgacagggtcaccatcacggtcaccggcgtcacgctcgcactccctaccgtgtcgaacctgtggtgctcgcccggcgtcacgccggggttcttcgacatgttcattcctcaccttcgccgaacgcctcttccgcccttccttccgcaaggatgacttggtatttgggaagaaacttggggagggcgcattcggggtcgtgtgtaaggcttcactggtgaaccccgaagaggcgaagaagcaaggggatctggtcttgaagaaagcaactcagtatggtgcaatggagatttggatcaaaggaaagtgtccaggaggagcatgcgctatttgctgtgccggattttcattttatggctttgttgcgatgacccatgccaaaaaggtaaagggaagccgaagaaaatattgggcttatctttgggggttttttaaaggggggaagcataacacttctaatgaaacctccatggaaaaagaaagggaaaattccccctttaaaaatgggggggaagaaaaaaaaaaattctctaggacgaggtatttcgccaa

SEQ ID NO: 89086 - DNA, 822 bp, Zea mays
  misc_feature: Ceres CLONE 1576628
  misc_feature: Encodes the peptide sequence at SEQ ID NO. 89087
ctggagctccccgcggtggcggccgctctagaactagtggatcccccgggctgcaggaattcgtctcacccctagaaaaaaacccccaccgctgctgtgcggcaccatcaccacaccatcaggaatcgggcgccacaccacccacaactctccaccccaccctcgccgcgcgttgctcagtcgcagcgagcgaggcggggccacaggccacagcgcgagcggggcggggcgggagggagggccagggatctctactctcgtccgtgcgggggcgtgggcgtcgcatgcggcggcgcgccggggcaaatgcgggtaacctcacggtcggaggagcgctgacgcggcggcggcagccagggagcgatgcaggcgccggagcagcagcagcagcaccagcagcggcagaggaagggttcatcagagatggacttcttcagtgaatacggtgatgctaacagatacaaaatccaagaggtcattggcaaaggaagttatggcgttgtttgctcagctgttgaccaacatactggcgacaaagtggcaatcaagaaaatacacaatatcttcgagcacttatctgatgctgcacggatcctacgtgagatcaaactacttcggctattacgccatcctgatatagttgagatcaagcatataatgctgcctccatcaaggagggacttcaaagatatctatgttgtatttgagctgatggatacagatctccaccaagtcatcaaggcaaatgatgatttaaccagagagcatcatcagttctttctctatcagatgctccgtgcactgaaatacattcatactgct

SEQ ID NO: 89087 - protein, 153 aa, Zea mays
  misc_feature: Ceres CLONE 1576628
  misc_feature: SWISSPROT Homolog: EC 2.7.11.24 Mitogen-activated protein kinase
MQAPEQQQQHQQRQRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTA

SEQ ID NO: 89088 - DNA, 903 bp, Zea mays
  misc_feature: Ceres CLONE 1576631
  misc_feature: Translation starting site: 159
  misc_feature: SWISSPROT Homolog: EC 1.4.1.2 Glutamate dehydrogenase
  misc_feature (767)..(767): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaggctaccagtgtcggtgaagaagatgtcctcatncttgatcttgggagtggtacctttgatgtctccctcctcaccattgagaaggatctttgaggtcaaggcacagctggtgaacccatcttggtgggtgagactttgacaacggatgtccaccaccttcgccaggagt

SEQ ID NO: 89089 - DNA, 1022 bp, Zea mays
  misc_feature: Ceres CLONE 1576632
  misc_feature: Encodes the peptide sequence at SEQ ID NO. 89090
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (103)..(103): n is a, c, t, g, unknown, or other
  misc_feature (1022)..(1022): n is a, c, t, g, unknown, or other
aggggggtgttggagggtttgtgggtggtatctagtctctctctcgcaagttaattcacatatttttnnnaaaggaagaaggtttaaaaactggagctcaccncggtggcggccgctctagaactagtggatcccccgggctgcaggaattcgtctcacccctagaaaaaaccgagcagcaacaagccaacaactaaaggcaggcgcggcacaccgcgacaccgtaccggcctagacacttggagaaaggagaagcagcgcagcggcatgggcaccagtcccgtcatccctgcgacgatgctcgtcgtcgctctccttgtcgttagtagtactgtctgcttcggcgccaccgccaccgacaccgacaccgacggcgccattcgtctccccagcagctctggtgctgttggtcgaccgtgggagtgctgtgactatgtcaccaaggagccgtttatcacgccgccccggtggcgctgcaacgacgtgggtgggacaagtgctcccgccgactgccaaagagtgcgagggagtcgccaggccggccgacgggctttcagtctgcccatggactgggaatctgtcaagcctgggctcaaagcccccccgggtcctggcaacacccccagggacccggtggagaaacttgacctgcacaaaaatttccccccggttcctgggcaccaaaagggggaaacttacccatttccccccccaaaacctggtccacaaaagagcagcggcgaaactcttgggattgggaaagatttccgttgtgcccccccaaatgcaaacaatgggcaaaaaaaggcggtgtgacaaaggacctttgggtggagaaaatccgggggaaaaccccttacctttcaggatataacccataagtgcccctaaataaaacagtcccttttacacacaaggagttattaaccccgggaggtcccccccaaaggtgcgaaaaacccacaagggggaacaccaagctttaagagaaaaccaaatttgtgtgccttcaagaatttaan

SEQ ID NO: 89090 - protein, 182 aa, Zea mays
  misc_feature: Ceres CLONE 1576632
MGTSPVIPATMLVVALLVVSSTVCFGATATDTDTDGAIRLPSSSGAVGRPWECCDYVTKEPFITPPRWRCNDVGGTSAPADCQRVRGSRQAGRRAFSLPMDWESVKPGLKAPPGPGNTPRDPVEKLDLHKNFPPVPGHQKGETYPFPPPKPGPQKSSGETLGIGKDFRCAPPNANNGQKKAV

SEQ ID NO: 89091 - DNA, 813 bp, Zea mays
  misc_feature: Ceres CLONE 1576633
  misc_feature: Encodes the peptide sequence at SEQ ID NO. 89092
ctccccgcggtggcggccgctctagaactagtggatcccccgggctgcaggaattcgtctcacccctagaaaaaacaaagcagtcctcccaccgcacgcaacgcagcctcgacctcgacctcgccgtcgccatggtgagcaagcagacccgccgcctcctcgtccttgccgccgtcgccgtatgcctccacctccccgccgcctctgtcgccaccgacgtcgattactgcagtgagtagagtatcctcgcccccgcccccgcgctccgtttgggtcctgtaaccggaatctgttcttgttcatggcctgcaggtaaaaaggagtacccggtgaaggtgagcggggtgcagatcgtgcccgatccggtcgagcccggcaagcccgccactttcaagatctccgcttctactggtatagtacttgacttattggttgcagcctccgtgtttgctggtgttacttgccgctggtaggagtcctgactcctgagtagttggttattttactccgcgatgaatttgacatacgtacgctacgaagagttagtaattaccaaccaaatgagttttgcgcaggactgaatttagttcgattttttttttccgctgtgttatttaagttttgtagggggtacttactagtacctttgggtgctgttgccggatgtaatttcttgtgcagcatgtcgtgcgctacgggggattggggattttttttttcctgtttccatcggccttactgtgcttgctgaagtgcttggtgttaagtttgcattggcaataaccggtttgaggagtttgtttcagggaaaca

SEQ ID NO: 89092 - protein, 35 aa, Zea mays
  misc_feature: Ceres CLONE 1576633
MVSKQTRRLLVLAAVAVCLHLPAASVATDVDYCSE

SEQ ID NO: 89093 - DNA, 822 bp, Zea mays
  misc_feature: Ceres CLONE 1576634
  misc_feature: Encodes the peptide sequence at SEQ ID NO. 89094
ctggagctccccgcggtggcggccgctctagaactagtggatcccccgggctgcaggaattcgtctcacccctagaaaaaacctgcgcctccacagtccacactcaccgcgtctcattttgttctgcgttcttccgctcgccccctcacaacgaaacctagagagtcccgcgcgtgacatggcggacggcgcgggctcggcgtctggtctggtggagaagctcgcggagctttcaacgggcagcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggctgctgctgctgctagtggaaagcctcagaaggcatctgctgctgacgatgatgacatggatcccactcaatactacgagaataggctcaagactcttgattcactcaaggccgcaggtgtaaacccctatccacataagtttccagttggcatctctgtagtggaatacattgagaagtacaagaccttgaacaacggggagaagcttacagatgcgacagaatgtttagctgggaggatcatgaacaagagaacatcatcatctaagctattcttttatgatctttatggtggtggcatgaaggttcaagtgatggctgatgccaggacctcagagttggatgaagctgaattctctaagtaccactcaagtgtgaagcggggtgatattgttggcatatgtggttatccaggaaaaagcaaccgtgggggagcttagcg

SEQ ID NO: 89094 - protein, 213 aa, Zea mays
  misc_feature: Ceres CLONE 1576634
  misc_feature: SWISSPROT Homolog: EC 6.1.1.6 Lysine--tRNA ligase
MADGAGSASGLVEKLAELSTGSAGQNPPPAGEGGEELQLSKNAKKREEKRKKLEEERRLKEEEKKNKAAAAASGKPQKASAADDDDMDPTQYYENRLKTLDSLKAAGVNPYPHKFPVGISVVEYIEKYKTLNNGEKLTDATECLAGRIMNKRTSSSKLFFYDLYGGGMKVQVMADARTSELDEAEFSKYHSSVKRGDIVGICGYPGKSNRGGA

SEQ ID NO: 89095 - DNA, 893 bp, Zea mays
  misc_feature: Ceres CLONE 1576635
  misc_feature: Encodes the peptide sequence at SEQ ID NO. 89096
gagctccccgcggtggcggccgctctagaactagtggatcccccgggctgcaggaattcgtctcacccctagaaaaaaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtcccaccgccccagaccacccgcgaaccagtccgctgcaggctgcaggccaccgtccctccagttcgccggtcagattattaaccattcaccacccacccaactccgcctagacgcgaatcctccgccactatggtggcagcggtgtctctgccgagccaagcacaggccgtgcttcggaagccggctctgcgacccggttcttcgtccactccgcccctcagtagctccctggacactaattacagcaagctgaaatacctcgtcccccagctgggcttccgaggcctgcaaacaattctgtcctcccccttggggcccccgcgggtgtggaaaaaccagcgggggtcgaacatgttccttgaaaatctgaagggaggaagaccccaaaaggcaattcccgggaatcaaactaaatggggaagctaccaaatgacagacacatgtggctttgaagggaaaatggccaaaaaacttttttttggagccatcagttaacctttttcaaaaagggatttctttcaaaagaaaaaccctcgaatttaagaattgccattttttcgggagaggcggaatattctatcaaaaaaaa

SEQ ID NO: 89096 - protein, 121 aa, Zea mays
  misc_feature: Ceres CLONE 1576635
MVAAVSLPSQAQAVLRKPALRPGSSSTPPLSSSLDTNYSKLKYLVPQLGFRGLQTILSSPLGPPRVWKNQRGSNMFLENLKGGRPQKAIPGNQTKWGSYQMTDTCGFEGKMAKKLFFGAIS

SEQ ID NO: 89097 - DNA, 993 bp, Zea mays
  misc_feature: Ceres CLONE 1576640
  misc_feature: Encodes the peptide sequence at SEQ ID NO. 89098
gagctccccgcggtggcggccgctctagaactagtggatcccccgggctgcaggaattcgtctcacccctagaaaaaaggcctcgctctggttggaaggtttggagaaactccccggctcgaggagatcgtgacattgagaggacgatgggagggcgcgcgctcctcctcctcctcctggtctcggcgttggtctttcatatccacgcctccgacccgctgctgtacgagccgttcgatgaggactttgatgggagatgggtcgtctccaggaaggatgaataccaaggtgtgtggaggcatgccaagagtgatggtcatgaggactatgggctccttgttagtgagaacgcaaggaaatactccataatcgaggagcttgatgagtcagttacccccccaggatggggacaccgcccctgccgttttgaagtgaagacttccaaaatggcctttgaatgcggaaggtggcctacctttaaggtacgttcccgcccttaaggaatcctgggtaggggaatgcccatgggaatttggaataaatgagaactccctaacgccttatttttggttttggggcccacaacaaagggggggggtttccccccccaccaaagggtttgcaatttaaacacccccttttaagccacacaagggaaactcctttaaaaaactcgggaacaaagagtttgttttggggggcaaatctcctttatagaaatttctcccccccccctttttggtgccccacaaattggaacaaaaagaatttcctcccacggggtttcccaaaaagaggtatattctcttgtggaaacccccgccacaaatgaaggtgctccaaaattttttttgtttaaaacggggggggggaggaaaccataaaaaggggggaaaatcttcctttttctcggggggagagtattttgagggaccccccatttttttgctcgcgcgcagaaaacactttttttgtgacccctctgaggaaaag

SEQ ID NO: 89098 - protein, 117 aa, Zea mays
  misc_feature: Ceres CLONE 1576640
MGGRALLLLLLVSALVFHIHASDPLLYEPFDEDFDGRWVVSRKDEYQGVWRHAKSDGHEDYGLLVSENARKYSIIEELDESVTPPGWGHRPCRFEVKTSKMAFECGRWPTFKVRSRP

SEQ ID NO: 89099 - DNA, 814 bp, Zea mays
  misc_feature: Ceres CLONE 1576647
  misc_feature: Encodes the peptide sequence at SEQ ID NO. 89100
tggagctccccgcggtggcggccgctctagaactagtggatcccccgggctgcaggaattcgtctcacccctagaaaaaaggagagacacccaccccatcaccggaagcaccgccaaaggccaaagccggccaattccgacgccatggccgacgtcgacgacgacgctgtcctctccgacgtcgacgaggacccactcccgcccccctccacctcttccgcctcttcccacaaatcccttccacaagcccaaccccaatcacagtccgatgcccaggcgcagcagcagcggctgctggacctggccgcggagctcgaggaggagcgccgcctccgccgcgcagccgaggcctccctcgcagaggctgagccccgcgtcgcccgcttcaaggccttcgcgcacgaagcgctccgcaagcgcgacgacctcaccgaccaagccgcgggcctcggcgggggtggcctcgccggcgcttcaagggcggagggccggcaacggccgttcctccattgctttcctccgggctttcaaaagggatctccccccaaaggggcttccccgtttcctggcccccccgggaccggttttccggaaactttcccaaaaaagttctcccctccgggggctcccccgggccctttctcggtaaaaggggggtgtttttttaaaagccccccccccaaaaggaaatatattcttttctaagaaaaaaacttcctgccccgccccccaaaatatcggagggccgcgcccgtctaaaaacgccgggggaaaacacgggcgtaaaattttcctctcccccccggggggggga

SEQ ID NO: 89100 - protein, 186 aa, Zea mays
  misc_feature: Ceres CLONE 1576647
MADVDDDAVLSDVDEDPLPPPSTSSASSHKSLPQAQPQSQSDAQAQQQRLLDLAAELEEERRLRRAAEASLAEAEPRVARFKAFAHEALRKRDDLTDQAAGLGGGGLAGASRAEGRQRPFLHCFPPGFQKGSPPKGASPFPGPPGTGFPETFPKKFSPPGAPPGPFSVKGGCFFKSPPPKRKYILF

SEQ ID NO: 89101 - DNA, 782 bp, Zea mays
  misc_feature: Ceres CLONE 1576649
  misc_feature: Encodes the peptide sequence at SEQ ID NO. 89102
ctccccgcggtggcggccgctctagaactagtggatcccccgggctgcaggaattcgtctcacccctagaaaaacccctagaaaaagacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagttccaaaccaactttatttagctatggatacactagctgatgagtttggcatcggaacactccgcctgacgaccaggcagacattccagttgcacggtgttcttaagaagaacttgaagactgttctaagcactgtcataaagaatatgggctcaacattgggtgcttgtggcgatctcaacaggaatgtacttgctc

SEQ ID NO: 89102 - protein, 197 aa, Zea mays
  misc_feature: Ceres CLONE 1576649
  misc_feature (112)..(180): Pfam Name: NIR_SIR_ferr Pfam Description: Nitrite/Sulfite reductase ferredoxin-like half domain
  misc_feature: SWISSPROT Homolog: EC 1.8.7.1 Sulfite reductase (ferredoxin)
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLA

SEQ ID NO: 89103 - DNA, 975 bp, Zea mays
  misc_feature: Ceres CLONE 1576651
  misc_feature: Encodes the peptide sequence at SEQ ID NO. 89104
tccccgcggtggcggccgctctagaactagtggatcccccgggctgcaggaattcgtctcacccctagaaaaagctaccccctcgcctcgtcctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatccggcaagttcttcgtcggaggcaactggaagtgcgtaagtgcatgttctgcttcttcagctttacacggcttggagacccaccccaccgatgatcctggagatgctgtgtaactgtatcattttttggctgttgccgcattgggcattcccacgggactggtacgagatttttttgtcgtcgtgcataccagggttccatccaccataggcacagtgttgcgcccggcctcccctccttggttcctgccgtacggcagtgctggggcgccggaaccatacctttttcgggattttactccgtagcatggcccacttcaagaaaatacatgcgcgttcccggggtgcccccgaccaatcttggttctgtccagccaaaagccgttttttgttccgtgattataaaaagagatgtccgccggtgtttttttgtggaaaaggcacggggtcataaaaagtttatagtgggaaccctttctccccttttagaaatccgttttggtcctccaaaaccatggggaagtccccctagtttccggccctccctgtgaatttaaaaagagccctgggtggcctttctgtggacctccctttggcgaaactatttgaggaagccttggtcccgggggaaaaagacccaataataccgggggtggggtctcgcttga

SEQ ID NO: 89104 - protein, 88 aa, Zea mays
  misc_feature: Ceres CLONE 1576651
  misc_feature: SWISSPROT Homolog: EC 5.3.1.1 Triose-phosphate isomerase
MAAAPSSLVSSHLSRLADLRRAAAPATPTVPQQLRVGFSRRRAQRVVAMAGSGKFFVGGNWKCVSACSASSALHGLETHPTDDPGDAV

SEQ ID NO: 89105 - DNA, 852 bp, Zea mays
  misc_feature: Ceres CLONE 1576654
  misc_feature: Encodes the peptide sequence at SEQ ID NO. 89106
  misc_feature (696)..(696): n is a, c, t, g, unknown, or other
  misc_feature (739)..(739): n is a, c, t, g, unknown, or other
gagctccccgcggtggcggccgctctagaactagtggatcccccgggctgcaggaattcgtctcacccctagaaaaagtaaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgttggacttgtttgccaaaactacagtggtctgtttcgacgccctaggggaatgtactttagtgcagaagatcgtgggggagatgatggtcatgggtgtancattggccagctgatcaggttgacatgaatagtggtgactgantggagcaggatattggggtcttggtggatctgggggtggcagggaattggccatggctattggaaaaatgggatttaattgttgctgccggcgggaataaatccccaaagggt

SEQ ID NO: 89106 - protein, 184 aa, Zea mays
  misc_feature: Ceres CLONE 1576654
  misc_feature (116)..(185): Pfam Name: malic Pfam Description: Malic enzyme, N-terminal domain
  misc_feature: SWISSPROT Homolog: EC 1.1.1.39 Malate dehydrogenase (decarboxylating)
  misc_feature (176)..(176): Xaa is any aa, unknown, or other
MSSISRNLRRSLAPDRLRRLSQHPREYVTSECHRPVVLHKRGPDILHDPWFNRGTAFSMTERDRLGLRGLLPPNVVSSQQQIDRFMLDLKRLQRYARDGPSDTYPLAKWRILNRLHDRNETMYYKVLIDNIEEYAPIVYTPTVGLVCQNYSGLFRRPRGMYFSAEDRGGDDGHGCXIGQLIRLT

SEQ ID NO: 89107 - DNA, 1257 bp, Zea mays
  misc_feature: Ceres CLONE 1576655
  misc_feature: Encodes the peptide sequence at SEQ ID NO. 89108
  misc_feature (29)..(29): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (976)..(976): n is a, c, t, g, unknown, or other
taagataaggccctaggggtccttgctcncttccccacagaacaagtcctactttcaaacccacaaannnccaaactggactccccgcggtggcggccgctctagaatagtggatcccccgggctgcaggaattcgtctcacccctagaaaaaatctctctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaagataccgttcagagaaaaagttatctacactgttatttcactcttcattttcctggtctggagccagctcccactctatggcattcattcgacaactggagctgatcctttctactggatgcgtggtgatccccccatcaaacccaggcactgtgaatggaattggggtattactccaattgctgacatcaggggatgggtaatgcaaccttctaggctggggtcgccagaatcgtctgcaagttgaacaccctgtagtgaagaatagcaaatcgaggcttcagccttgcaatttggtgggcacaaggaaaggattgacatgtggggaactacgcaggatatttgctctttattttgcataagataaatccattatttagccccaataatatatgcggcccgctagtattccatctagtcaaattcgttttcgagggtgacaaaaaatactggatgatacaatgaggggcgacaagtctgtttttgtgtgcaagaatctataggggggggtaaaaaataggggactcataaattcacccctgtcaaatattatgatcatattactacatttggcagaagcccccttgttctccgtcttgaactaaaccacacaggtgtatataaacattatncgtcggatacactatattgggcagaagaatggggggatgaatctgagatcgtggaggcgtaatagaaagaaaaaagggtccttattactatccgtccgcgtgcagatgatactggtgcgggaatattttttcgccaccagtcagaagcaaatggttactatcgagaaaaataatattatggcgataataaaaacataaccaacgcgctggggggagtgtgatgtcaataaaggttctgctccgagagcggatctcttatacggagttttcaggatatagag

SEQ ID NO: 89108 - protein, 108 aa, Zea mays
  misc_feature: Ceres CLONE 1576655
MAGGFRVLHLVRPFLAFLPEVQSADRKIPFREKVIYTVISLFIFLVWSQLPLYGIHSTTGADPFYWMRGDPPIKPRHCEWNWGITPIADIRGWVMQPSRLGSPESSAS

SEQ ID NO: 89109 - DNA, 811 bp, Zea mays
  misc_feature: Ceres CLONE 1576656
  misc_feature: Encodes the peptide sequence at SEQ ID NO. 89110
  misc_feature (504)..(504): n is a, c, t, g, unknown, or other
ctggagctccccgcggtggcggccgctcttcaacttttggatcccccgggctggaagaattcgtcgcacccctggagaaagtgttctccgctggttggctccggctccccaattgcacgagatctcggattccaccgcctctgctctgcatccatgaccccataccccgatcgatccctaaagcccatggttttctcctccaccgcgtcgcctctagtagcaaccgctgctgactctgcttcctcctgcgtcgcccacctccgctgctgctgtcgcgttagttgctgccgtttgtgaagacgcttagatctctaaggttcgcgatgtctatctgatcgattcaagaataggtaagctatggatctctcacggcccacatcgacagacctctcgctcgggcatcactctctctgtcacgcacacgcccacaatcgctagcgcgcggtagccgagacactgcgcatgttcgatgacgcttaggaaccaatccgaaacacctcgtgnaccgagagccgacgcagatatggatgacgaagacgggggcgaccatgacttgccctgctcgggccttcttcttggccaaagcccaactgcgccggtaacggctgcgggggcgaaaagaatccttcccgatccttcaagtacgcggggcttggtccttgcaaggtaaaagaggacgggggagggaaagcgggggcaaaaattggaaaacccccccggccgcggggccccgggcggagggggaataatccccgggggggaaggcccaaccccgaaatttttcctccccgtatatagaaaaaaaagagtt

SEQ ID NO: 89110 - protein, 36 aa, Zea mays
  misc_feature: Ceres CLONE 1576656
MVFSSTASPLVATAADSASSCVAHLRCCCRVSCCRL

SEQ ID NO: 89111 - DNA, 937 bp, Zea mays
  misc_feature: Ceres CLONE 1576659
  misc_feature: Encodes the peptide sequence at SEQ ID NO. 89112
  misc_feature (759)..(759): n is a, c, t, g, unknown, or other
  misc_feature (782)..(782): n is a, c, t, g, unknown, or other
  misc_feature (787)..(787): n is a, c, t, g, unknown, or other
  misc_feature (869)..(869): n is a, c, t, g, unknown, or other
  misc_feature (905)..(905): n is a, c, t, g, unknown, or other
ctccccgcggtggcggccgctctagaactagtggatcccccgggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcactgcagcctgctgaagtctttacttgctgcattctgtgctcacttttgaaagctgctctcttctgctctgcgttgttgatttctgcactcaagcttctcttgcctgtgcactcaagcttctctcttcctgggcaactagtgatctccttgaagcatttcagcttttacctagagatctttctgttgttgaaggcaaagagagctttanggtgatggcgcaaactagcctgnctccntggttttcgtttccaccccacccgatgtgagctcgtttcctattacttgaaagagaagatcatgggaaaagaacatatcgtngatggctatagcagaagttgatctgtacagtttccntcccctgggaatctatgtgacagtcctcccct

SEQ ID NO: 89112 - protein, 29 aa, Zea mays
  misc_feature: Ceres CLONE 1576659
MSAEVAGGHPYFLSCYFWFIYCIKFRDFT

SEQ ID NO: 89113 - DNA, 1018 bp, Zea mays
  misc_feature: Ceres CLONE 1576661
  misc_feature (10)..(10): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (1018)..(1018): n is a, c, t, g, unknown, or other
tggtgtttcnccaaagaaaccggctacccaacactaaacaaataaagggattaatttatctctttcnnnnnnnnnnaaaactggaactccccccggtggcggccgctctagactagtggatcccccgggctgcaggaattcgtctcacccctagaaaaagcttcctcccgtctcgtctccgacgacctcgtctttcccccccagccagcctcgcctcaccgactccccgatccggtccctcccttcgccagctatgcatccctcctccggcgcgggggactacgccccttactacccaccttatccctccccggccgcgccgcctcccgccgcctacccgtcggtgtccgccccggcttctgcgcccccgtactcgtcgtaccccgcggacttcgcccccgcgccttcgtaccccgcgtacccgcccgccgaacctcccccactacgcgccgccgccggctgcgcccgcgcccccgcagccgtactacccctacgagccggcgccggcgccaccgctgccgccgtccccgcacaaaccgggttccctctccgtacccagtcgctggaatcgggcgggggagctacgggctacgggatccggccccttggctccggggtacggcccagagaggctgtaaccccgccccaaggcccgggcggggccgggttgggtccccaaccgaaccggaaacggaaaccgcctgtaacaaatcgggacggggcggaaacccccgcccgaggaaagcaccgttaactggggggtctccagggggggccactccggccatcccgaaggagcccccgggccttccggggaaatcccggcgacacttgtttttggattggaaccttaccgggggaaagggtccaattttgggagctccacgccttggcacgcaatattggggagtgtgggccccgggggaggggtataatcggcgggatccaggcccccccaaagggtggtgtggaaaggggcacacatggccccccaaagggtcacaaaaacaatttcggn

SEQ ID NO: 89114 - DNA, 885 bp, Zea mays
  misc_feature: Ceres CLONE 1576663
  misc_feature: Encodes the peptide sequence at SEQ ID NO. 89115
ctggagctccccgcggtggcggccgctctagaactagtggatcccccgggctgcaggaattcgtctcacccctagaaaaaacacataagaggcgacatctcatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggactaagctcggcgggaaggcggcgacccggcgcccagcatcgtcatcaagatccgccgccggctcccggacttcgcccgcaacatcaagctcaagtacgtgaagctcgggatccgccacggcggcagccccacgtcgctgctgccggcgctctgcgtgccggcggtcgccgccgccgcctactcgttcgtccgcctcgacgtcatctactactccgtcgacctgctcacctgcgtcgcctggctcggcaccgcgctgctgctgctcaccgtctactacctcaagcggccccgccccgtgtacctcgtcgagttcgcgtgctacaagccggaggagcggctcaagatctccaagtctgccttcctcgagatgaccgagagcaccggctccttcaatgaggcggctctggacttccagaccaagatcaccagccgctccgcgctcggggacgagactgtactgccccccgggcgtccaggcgcgcccgcccaggcttaacatggcggaggcgcgcaaagaagccgtagcggtcatgttcgggtgcctggacgcgctgttccaatcacggtgatcgtaccgcgccgcgacgtgcgcatcctcatcgttcagtgaaagcctcttataccgatgcctgtgg

SEQ ID NO: 89115 - protein, 42 aa, Zea mays
  misc_feature: Ceres CLONE 1576663
MTESTGSFNEAALDFQTKITSRSALGDETVLPPGRPGAPAQA

SEQ ID NO: 89116 - DNA, 857 bp, Zea mays
  misc_feature: Ceres CLONE 1576664
  misc_feature: Encodes the peptide sequence at SEQ ID NO. 89117
ctggagctccccgcggtggcggccgctctagaactagtggatcccccgggctgcaggaattcgtctcacccctagaaaaagaatgaagactgccactcgtccgggttttggtacttcccggcctcagtccaccacctgctgccaccgcgcgggcccaaccttacatacttaagcgcagcaatggcgcggccctagcgccatcgtggagagcgacccgctgaactggggcgcggcggcggcggagctggccgggagccacctggacgaggtgaagcgcatggtggcgcacgcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaagtcacccgcgcggcgatgctggtgcgcatcaacaccctccctcagggctactccgggatccgcttggaaatcctcgaggccatcacggaactggctcaacacccggtgtcagcccctggcctgccgctcccggggcaccattcacccgcgtccgggggacctgggtccccgcttcttcctaacttcgccgggccctaagcaagggggccgtccccaagggggacaggccggtcccccggtggtaagggaaagg

SEQ ID NO: 89117 - protein, 174 aa, Zea mays
  misc_feature: Ceres CLONE 1576664
  misc_feature (9)..(175): Pfam Name: PAL Pfam Description: Phenylalanine and histidine ammonia-lyase
  misc_feature: SWISSPROT Homolog: EC 4.3.1.5 Phenylalanine ammonia-lyase
MVAHARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLPQGYSGIRLEILEAITELAQHPVSAPGLPLPGHHSPASGGPGSPLLPNFAGP

SEQ ID NO: 89118 - DNA, 810 bp, Zea mays
  misc_feature: Ceres CLONE 1576666
  misc_feature (711)..(711): n is a, c, t, g, unknown, or other
ctggagctccccgcggtggcggccgctctagaactagtggatcccccgggctgcaggaattcgtctcacccctagaaaaaacacggccacaccaacccaacacctcttcttcctccgctctcagcttaccccaccacaggcgagggaggcgactccttcctcgcggctacccgctccggccccgatcgcatctcctttgcacgccacggcccgcgcgcagtgtccaccggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacaggttcagctcccatcaacctccggcctcttagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacaaactcagccctctcacgttactttagctgaaagggtcgtactgggtacagaacccgnagggatggaagcaaagcaacaggggggtaaagggggcccctgaaacaccataatttgaaaatttccccaggggggaaaattggggccccccccccggca

SEQ ID NO: 89119 - DNA, 943 bp, Zea mays
  misc_feature: Ceres CLONE 1576667
  misc_feature: Encodes the peptide sequence at SEQ ID NO. 89120
ctccccgcggtggcggccgctctagaactagtggatcccccgggctgcaggaattcgtctcacccctagaaaaaacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatgttgctgctgttagtgcgggcaacaactacgaaattggtaatatgatagcagaagccatgagcaaggtcggtcgggaagggtgtgtttaccctcgaagaaagggaggagtctgaaaacttctctatgttgtggagggaaatgcattgatcgtggtatatctctccgactttgtacagacgtgagaaaatgtctgcgagtataaactgcagctacttttggtgacaaaagatcccacgcatggatctatcatgt

SEQ ID NO: 89120 - protein, 216 aa, Zea mays
  misc_feature: Ceres CLONE 1576667
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNMIAEAMSKVGREGCVYPRRKGGV

SEQ ID NO: 89121 - DNA, 862 bp, Zea mays
  misc_feature: Ceres CLONE 1576668
  misc_feature: Encodes the peptide sequence at SEQ ID NO. 89122
ggagctccccgcggtggcggccgctctagaactagtggatcccccgggctgcaggaattcgtctcacccctagaaaaaccgcacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacaccccccaccaagacccgtgggcctgggagctgggcaaggctgcccgaacctcaccctactgggaaaaacgctgccccgcatgaatggggggatgtctcccaagtttggaaaaaaaattgttgtgttaaaaaaatcccccggttccccttgttaaaaacccggggaggggttttttgaaaaaagaattttggccccccccaaacgcgaggggggggtttcaaactttccccggaaatttctttttcaaaacaccccaaaagaattttccttttcgggaagagggggccccctgccccctattgggagagaccatcgtttttttaaaacccctccatataaaaaagagtgcctt

SEQ ID NO: 89122 - protein, 114 aa, Zea mays
  misc_feature: Ceres CLONE 1576668
  misc_feature (2)..(114): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPHQDPWAWELGKAARTSPYWEKRCPA

SEQ ID NO: 89123 - DNA, 802 bp, Zea mays
  misc_feature: Ceres CLONE 1576670
ctggagctccccgcggtggcggccgctctagaatagtggatcccccgggctgcaggaattcgtctcacccctagaaaaaatcaccttccgttcagatcatactcgagtggtgcatgcctatccaactgttcccaacttgaacttccgatataatagtatcatctcgtaggtagccggcccgacgttcggagcctcctgccaaaatttatttttgacgttggccaggttcctaacgtcccggctagaagagaatcccgtggcccctaggctctacagagcggtcagaagcatgggcggccagctgcggtttccgtttcctggttggcccgagaattccgatgcctctcctgatttatgttgactggaggccgaggggctgtacccacgctatctgtatcctcaccctgggctgttatccgcggtcccaccggtcgaaagcatctgcctaatcacgcgtcaggaggccgcgtagcacccgcggaacgtctcttggggtgcaacgctgcaacagattatggcagcctgaccgccgtgaggccagcatccctcttcagaatgcgtgctcaggcggagacagcccaaccgccgttcgagcgcgagacttcctcgctctgaatgtggagaaattagatacattgtggaagatgagatcatgagttcggtaacttcaccagatccacctatgtatccagctctatgcagaggggaactcacaaagcgcctgattgctcaggctgcataatgctttaatcatgtgcggatcgactccgcgatcactgagcatgtcacgtcgatactgacg

SEQ ID NO: 89124 - DNA, 1040 bp, Zea mays
  misc_feature: Ceres CLONE 1576671
  misc_feature: Encodes the peptide sequence at SEQ ID NO. 89125
  misc_feature (1040)..(1040): n is a, c, t, g, unknown, or other
ctggagctccccgcggtggcggccgctctagaactagtggatcccccgggctgcatgaattcgtctcacccctagaaaaaaaaaaaaggcacgccccacccagtccagtccccaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggtgggggggcccgcgttcgtgggccaagtgttcaccatgctccacccatccgggaaccggctcatgggccgttaccacacgccttcgagctcccccgccttcctcaccaaaaagaactcctatgtgggtccaaaagatgcctatcccccgccgaagaaaaaccgaaaaatagtcccatgtatttagggttttttaagggatcctgaaatagaagccattaccccctttgtaaaaaggaaccctaatttgtgcccaagccggccatggtgggggggggcttttttccccccttggagtgttggccattatgaaaaccttttcatgggaaaaagcccccccaatgttctccgcttttttttcccaaaaaaaaaaaaaagggcccaaggcttcccaaaaaaacgttttaaaaacccctcccccaaagggggggaaaaagaaaaaaacccgggggggggtcccctttttttaggcgccaaaacttaaattttgtggggcgcaaaatttgggagaattggggtcccacaccccttttttgtaaaaaaatgggagaaaaatcccggagtgctggaagagaaattttcctcttaaaaaaaaacccaccacccctcaaagagagtttgtgcgcaaattccacn

SEQ ID NO: 89125 - protein, 150 aa, Zea mays
  misc_feature: Ceres CLONE 1576671
MPCSSSSSSNPFHSLASAFPFLSSTSPPPSPPASPAPAAPHLAVPLLLPVSSASESRRGAQPLPGTRMVGAGATGGGNMASGGGGARVRGPSVHHAPPIREPAHGPLPHAFELPRLPHQKELLCGSKRCLSPAEEKPKNSPMYLGFFKGS

SEQ ID NO: 89126 - DNA, 1100 bp, Zea mays
  misc_feature: Ceres CLONE 1576673
  misc_feature: Encodes the peptide sequence at SEQ ID NO. 89127
  misc_feature (26)..(26): n is a, c, t, g, unknown, or other
  misc_feature (28)..(28): n is a, c, t, g, unknown, or other
  misc_feature (64)..(64): n is a, c, t, g, unknown, or other
  misc_feature (65)..(65): n is a, c, t, g, unknown, or other
  misc_feature (68)..(68): n is a, c, t, g, unknown, or other
  misc_feature (1100)..(1100): n is a, c, t, g, unknown, or other
tggtgtgtgttgggggggtggcggcntnggtcctttgttcgggggggggggggtgggggttaannaanaaaatatatttttaaaactggaactcaccgcggtggcggccgctctagaactagtggatcccccgggctgcaggaattcgtctcacccctagaaaaactcttccgcatcgcatcgagagcggggctgtacagtgcgagactctactgctcgatcgccatggccgccgcgctcaggtgcccggcatccgtcaaggtctcgggccccgccgccgcggggctcgccaaggtgcgccaggcgtccagagtcgtagcggtgagcggggcccggcagagccgcggcggcggcgtcgccgtgcgggcgtcgctgttctcacccaagcccgcagcggccaaagacgcgcggccgaccaaggtgcaggagctgtacgtgtacgaaatcaacgagcgggaccgcgagagccccgcgtacctgcgcctcaggggcccaaacagacgggaaaaacgcgcctgggggaaccttcgtccccctttcaccaaacaaggggtggtacaaacagggcaaccccgggaacaaagcgggcctggggccgatacaaccgccgggggcaatccctggggggtgggcctgcaattcccaggccaaaaggtctccccccgtaacccggccttaagcgggggcggaaacccgcgccaaataacaaaaaggggccacacatttctcgtaagaagagggggcgtgttcgcttatacccttgtctcccgcgggaaaaaaaacactcttacgcggtggtcgccccacccatttcctcttccggggaggtggcacaagggggggccccccccatgttgaacaccgtggagaacccccgttaacataaaaaggaaaatttcccgtttaaccacccttgagggggggtggcccacacaccggagtgtggggactcttcctcgggggcgttccttttatacaaaggggggggcatttctttaaaaggcgcgcctaggagatctgaaaacgcttgtcatatccccaagaaatctgcggccctttcctcccccttttttaaaaaggaaaccttctttctcaccccn

SEQ ID NO: 89127 - protein, 210 aa, Zea mays
  misc_feature: Ceres CLONE 1576673
  misc_feature: SWISSPROT Homolog: EC 5.3.99.6 Allene-oxide cyclase
MAAALRCPASVKVSGPAAAGLAKVRQASRVVAVSGARQSRGGGVAVRASLFSPKPAAAKDARPTKVQELYVYEINERDRESPAYLRLRGPNRREKRAWGNLRPPFTKQGVVQTGQPREQSGPGADTTAGGNPWGVGLQFPGQKVSPRNPALSGGGNPRQITKRGHTFLVRRGGVFAYTLVSRGKKNTLTRWSPHPFPLPGRWHKGGPPPC

SEQ ID NO: 89128 - DNA, 908 bp, Zea mays
  misc_feature: Ceres CLONE 1576676
  misc_feature: Translation starting site: 148
  misc_feature (813)..(813): n is a, c, t, g, unknown, or other
tggagctccccgcggtggcggccgctctagaactagtggatcccccgggctgcaggaattcgtctcacccctagaaaaaactccgatcggccgaccgatcgcctagcttccccgttccctccccggcccccgcgacgccgcgacgccatggagctgccgcacgccgagcaggccgtcgccgctgtagcagcaggaggagagggcggcaccgcaagcccgggcaccgtcctcgaagggccggtgcttaggcaggggctggacggcggtggggaaggggaggacggggagctgggggccgggcatgaggcggacgcacggataccggaccggcctgtctaggcggactgtggctactgactccccacgggagcctgcagcttcagggagcattcccgctacaaacatccccgtgatggtgggggcactgaagatatctgaggtgctgctgccacctaatgcgctaaggccaattgctaatgtttactgatagagtcgcagcacatggctgtccaagactcgcctgtcacgccggactgataaatagtgtcttcttaaaagctatttcggaaatcttaatttcggtggaggtaccaaggatggcgcaccacatgacttacctgaacgacaggggcgaccgtgtatgcgagtactatctgaagactagaactcgtaaatttggttccaatcgccaatatcaccatcctaatgcaaatggatctgtgcgctctgttatactatacagaatggcattcctctacgcctcggttgacaaagatgctcctactatatgaagactgggcaatgcacgctgcntcacaggggaaattcacaccccagaattggtggtacttccgcgaccccgggatatatcacagtacatcacttcggggcctgccctatcataggtc

SEQ ID NO: 89129 - DNA, 812 bp, Zea mays
  misc_feature: Ceres CLONE 1576678
  misc_feature: Encodes the peptide sequence at SEQ ID NO. 89130
ctcaccgcggtggcggccgctctagaactagtggatcccccgggctgcaggaattcgtctcacccctagaaaaacgccgcgtgcctgccattctcctcccgagccttcttccttcacgcctctttgccgcagcgcgggtgggtcgtcgtttgctgtttgttccgagatcaccggagccagccagccagccacagccagccagagtcagagatgaggtggtcggcgttcctgtgggaggccacgtccggccgccgcccgggggtttccaacctcctcctcgtcgtcgcagccgccagtagcggaggtctcgtcgcgtacgccgactccggatcagatgctgctgtccagcagccgcagcttcctccgaggaagaaggtcgtggtgcttgggactggttggggcggcacgacgttcctgaggaacctcgatagccgactgtatgatgtgcaggttatatctcctcggaactacttcgcgttcacgccgctgctcccgagtgtcacttctggaacagttgagcctaggagcattgtggagccaatccgtagggttttgggagaagaaaagtgggagaaatcaaattttggggaaagcagagtgtttcaaagattgatcccacaaagcaagaaaaatccatttgtcgcctcgaaatgttgggggacaaacctttgaggggggaatggcggaggttcttgggtttgaactattgaactattcttccgggggttaaccaagtttggggggcttagggaaccaaaatacctttcccaaataacctcccggggggggtggggataaaaaaaaaaattgca

SEQ ID NO: 89130 - protein, 153 aa, Zea mays
  misc_feature: Ceres CLONE 1576678
  misc_feature: SWISSPROT Homolog: EC 1.6.5.3 NADH dehydrogenase (ubiquinone)
MRWSAFLWEATSGRRPGVSNLLLVVAAASSGGLVAYADSGSDAAVQQPQLPPRKKVVVLGTGWGGTTFLRNLDSRLYDVQVISPRNYFAFTPLLPSVTSGTVEPRSIVEPIRRVLGEEKWEKSNFGESRVFQRLIPQSKKNPFVASKCWGTNL

SEQ ID NO: 89131 - DNA, 921 bp, Zea mays
  misc_feature: Ceres CLONE 1576681
  misc_feature: Translation starting site: 670
  misc_feature: SWISSPROT Homolog: EC 1.10.3.1 Catechol oxidase
aagctggagctccccgcggtggcggccgctctagaactagtggatcccccgggctgcaggaattcgtctcacccctagaaaaaagagaccgggcactgaagtgcaaacgactctctgtactactagattgacctgcaccaccaatcgatgtgccgcaccaccctcccaaatccaaaccgatggcatcactcccagtgtcggcttcattctccaccactggctgcgggcgaccccttgcgccacctccattcccctcttctcaggtccctctgcatgcacctccaacaagaccaccctcccctggttccagcgcacgacagccacgtgccgaccgacaccgcccgtggcgctggccggtgctgcgaaaatgatggcctcttgtggctacccccggcggacctgatgctcaaccccctaaccagagtccccaccggaatagactgacacccgcgtctcccgtcccgtgcccatcccgtagtgccgccggcactaaacgcgaacgagaagaccctgcagggcacggacgcggcctggcagcttccgtgccctctggtgtcgcctaccgaccccgtggacttcaagcctgaaagcaaggtgacgcgcatcccgcatcctgtgcatctcctgagccgggagtaccaagagaagtacaagcacgccgtcgcgaatatgaaggcgctaccggaagagaacccgctgagcttcgcggcccaggcggccatccaccaggcttactgcgacgcctactacaagtacgacccgacggccatagacgcgccgttcgacgtgcacatctcgtggatcttcgcgccgtggcacgcatgtacatctacttctacgagcgcgccctcgggcaggtatgggcgacgacaccttcgagctgacgttgctagactgggacacccggggccgacatgctgt

SEQ ID NO: 89132 - DNA, 878 bp, Zea mays
  misc_feature: Ceres CLONE 1576682
  misc_feature: Encodes the peptide sequence at SEQ ID NO. 89133
  misc_feature (734)..(734): n is a, c, t, g, unknown, or other
ctccccgcggtggcggccgctctagaactagtggatcccccgggctgcaggaattcgtctcacccctagaaaaacttcttctctctcctcctttcacagtcctctccgaattagctgccacttctggacttgtacttaccggacaaccgcaccttgaatatagatggagctccgcacatactcactctacggccgcctgcaccacatcagcagacatgacttactctcataacttcaacaacgggctgcttgcagcggcgtgtcctcacctactttgtgctctttaaagtgcattctgctggatttgcatgacaacagacaaggtgcacgacacaccctttacatccactacacctcatgtaacgtgccgtatacttggatcaaactgccccagagcatatcaccttcgactcaggattaatgctggcctgttctacaaatttattggcttccgtgaacaggatgtaacctacttgacctacttcatacaaaagaatatttgtgtcacaccacatgaaaaacacttttctgatacatgatcataattggccacggattcatatatatggaaacatgctcacctgtatggctggatcaaagcaggcatttgaggtgactctaccatatgttggactcacccagatgctactatacacagatgttctcttagagcttcatgttgatgatactactgcatgctatgagaaagactccctcatgaattccagttttcnatggcctacgtcaagactcactttcatggaaatcagagtcgccactcagcatcatatttttggacgacaatatgcaatttacagaggtagctcatctaacaaccctttggtccatttggaagtattttccatcttacggcgaga

SEQ ID NO: 89133 - protein, 121 aa, Zea mays
  misc_feature: Ceres CLONE 1576682
  misc_feature (74)..(74): Xaa is any aa, unknown, or other
MKNTFLIHDHNWPRIHIYGNMLTCMAGSKQAFEVTLPYVGLTQMLLYTDVLLELHVDDTTACYEKDSLMNSSFXWPTSRLTFMEIRVATQHHIFGRQYAIYRGSSSNNPLVHLEVFSILRR

SEQ ID NO: 89134 - DNA, 788 bp, Zea mays
  misc_feature: Ceres CLONE 1576683
  misc_feature: Encodes the peptide sequence at SEQ ID NO. 89135
ctccccgcggtggcggccgctctagaactagtggatcccccgggctgcaggaattcgtctcacccctagaaaaaacccgcgcccgcgcccacgcccacggccgcaccaaccaccagccccgatttcctcctaatcaatcacaccccccaaaccaaaacccaaacagcacttctcctgcaatcgccgacgtcgccggaggcttcgccggccgaagcagcgccgaaggttgttttgcccctccctcgtccggccaagcagcccaggcgagcatgccttcgattgcgccaccgtcttcctccgtcgctgccctcacccgtcaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaacatcccgttgctgaccccgtactccaaatggatcccatgatacgccagaaatcctctctggctatggggaaacgtggtatagacattgttgcagaagatgacactgatactggaacttgatttggataaccccaacaaagggcttcccatccaatggcaaaagcccttgggggaacttccacaagggaaaacctgggattggtggtttgaagaggaatccagggggaaaatgaaggggaatcctgaataaagggg

SEQ ID NO: 89135 - protein, 127 aa, Zea mays
  misc_feature: Ceres CLONE 1576683
MPSIAPPSSSVAALTRQPVQFFKGCSVSKETKGPVRSFFTANSKSTKVKSAGLKVASSFKNDGGYPAGGVSWKDDTLLPKSTTIRGQEHPVADPVLQMDPMIRQKSSLAMGKRGIDIVAEDDTDTGT

SEQ ID NO: 89136 - DNA, 814 bp, Zea mays
  misc_feature: Ceres CLONE 1576685
  misc_feature: Encodes the peptide sequence at SEQ ID NO. 89137
ggagctccccgcggtggcggccgctctagaactagtggatcccccgggctgcaggaattcgtctcacccctagaaaaaaacatccagccagcagcacacgcacactgttctttcgacttccatctcgaccggagcagaagatggaggtggctctgggaacggccaagtatctccttggccatgttctcaataatctccccgacgactggatgaaatcctacgtgtccagcgccgagctcggcaccaaccttaacatgatcaaagagaagatgcggtacgctagagcgctgctggacgtggccaaggggagggacgacgtcgtcaccgggaaccccaacctgctggagcagctcgagattctcggcaagaaggccgacgaggctgaggatgctgtggacaagcttcactacttcatgatccaggacaaacacgacgggactcgagacgccgcaccggagttgggcggtggcctcgcagcccaagctcaccatgcccgccatgctgctcgccacactgctgaaatatcacaatggatggattcgatcctcacatcacattcagcctcaaggatctatgggtgtacaatgagaggaatgatgggactgatccgtattctgtagcagcagatctacttgtagcggcggtgaggaccaaaacaatgcccgacgtttccttcaaactggtgagccttgatgtggacagcatctcgggagtgcttgttgctcccatctgcaggctgctctccgctaccctcggcgcgtttaagttcagaaatgattgggcggacatagcacttcacaaaagagcagaacga

SEQ ID NO: 89137 - protein, 159 aa, Zea mays
  misc_feature: Ceres CLONE 1576685
MEVALGTAKYLLGHVLNNLPDDWMKSYVSSAELGTNLNMIKEKMRYARALLDVAKGRDDVVTGNPNLLEQLEILGKKADEAEDAVDKLHYFMIQDKHDGTRDAAPELGGGLAAQAHHARHAARHTAEISQWMDSILTSHSASRIYGCTMRGMMGLIRIL

SEQ ID NO: 89138 - DNA, 798 bp, Zea mays
  misc_feature: Ceres CLONE 1576688
  misc_feature: Encodes the peptide sequence at SEQ ID NO. 89139
  misc_feature (579)..(579): n is a, c, t, g, unknown, or other
  misc_feature (580)..(580): n is a, c, t, g, unknown, or other
ctggagctccccgcggtggcggccgctctagaactagtggatcccccgggctgcaggaattcgtctcacccctagaaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggnngaagaggcaaaggaggggagaagatgtagttcaccccacttaagtttctctggaagatcttttacatggcaccctcaagaagctctctctttcgcgcaatgtcatctgctccaagtgcaagggcaagggctcgaagtcctgtgcctcaatgaagtgcccctgggtgcccaggctcagggatgaaaggcactattcgtcagcgtgggcctttcatgaaa

SEQ ID NO: 89139 - protein, 125 aa, Zea mays
  misc_feature: Ceres CLONE 1576688
  misc_feature (13)..(71): Pfam Name: DnaJ Pfam Description: DnaJ domain
  misc_feature (112)..(112): Xaa is any aa, unknown, or other
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSRXKRQRRGEDVVHPT

SEQ ID NO: 89140 - DNA, 1012 bp, Zea mays
  misc_feature: Ceres CLONE 1576690
  misc_feature: Encodes the peptide sequence at SEQ ID NO. 89141
acccgcggtggcggccgctctagaggtaggggatcccccgggacgggcggaatgctgtctcaaccctagaaaagaggctcgccccctgcgccgccttcggtagtctgagctcgccgctccaccacgtcgccgccaaatgccactaccagatcgttgcgttgctgctgggagaacggagcggacgtgaacggcaggaacatctaccggcatatcgcgcttatgcatgtttgtctgttcggcccctgggaggtggttcagacgctgcttgtgttcatatgcaacgtgggaaatgcggacagcctgaaatcgcaagaacggggttgtagtttggcggccgtttgtttggcacgtcagggggtccccccccctccccctgaaaggaattggggggcctgtgttccccccgcaccaattctcctttaaacggggtgggacaactggggggggggggtgtattaaaaatgggttttgcgcccttgggggggcggtttgtaggggggcaacgcctgagaggaggggcgcaaccccggtttgtagagaaaatagaaggtggggggcaatgtttttttcgagaaggtgaggagactatggcccataataaatcgtgggggggcggcaccaaaaggaggagttttctcggtagagggggccctcgccgggttttatggagacgcactctgtctatactctaactttgggctcgcggcgtgtcattgtggggaggctgccaagtagtctctaaagagtgggtttcttcggaggaaaaaaaccatacatttgtgttattttctacggcgggtgcgtggtgtatagtaagggggtgcgcccccccgtttttagaagagcaggcaagagaaggttgggtgatagttttggtggcgggtggggggatagtatggtgtgcattaatataaacacgccgttgtaggttatgctatagcggtgaggcggggggtggtgatgatttgatttattgtgtgtgagttgtaacagagggtattattggctcccc

SEQ ID NO: 89141 - protein, 67 aa, Zea mays
  misc_feature: Ceres CLONE 1576690
MHVCLFGPWEVVQTLLVFICNVGNADSLKSQERGCSLAAVCLARQGVPPPPPERNWGACVPPAPILL

SEQ ID NO: 89142 - DNA, 779 bp, Zea mays
  misc_feature: Ceres CLONE 1576692
  misc_feature: Encodes the peptide sequence at SEQ ID NO. 89143
caccgcggtggcggccgctctagaactagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcggggagtccacggcagcaacaactggggagggtctgcctgaccccatcgacggcgtgctcctccaggagctcatccgctacggggagttccccccaggccacctacgaaagctttgaaataacaacggtttttcccccctaatgggggaaagttggaaattacccgggggaaaaacttttttccccaaaatttgggctttggggggggattgggtttaaaaagggcacccccgttatccttttaacgccccccgtgggaaaaaacccttaagggtttccccaaaaattggggggga

SEQ ID NO: 89143 - protein, 93 aa, Zea mays
  misc_feature: Ceres CLONE 1576692
MAATVSSCLSLVPTVHHRAGGFPSSVALTNTLQRRRRSRRYLVVASATRAEQEAAPVTIEDVDLSSHQAAADDGELAARWRGVHGSNNWGGSA

SEQ ID NO: 89144 - DNA, 855 bp, Zea mays
  misc_feature: Ceres CLONE 1576695
  misc_feature: Encodes the peptide sequence at SEQ ID NO. 89145
aagctggagctccccgcggtggcggccgctctagaactagtggatcccccgggctgcaggaattcgtctcacccctagaaaaattcggattcgtccctagctctagttcttcctttcctccatagtgatggccacttgctactctgattggacaccgattccgcctttccttccatcgcgaagaacgccggctcattcccacgcctccccgatcacgatcacgctgcagatcttgtccttcgcgctccagtgctccagatcctgcgctccccctcctcgagccctagaacctgcccgatgagttctaggccgtgcctgcgacgactacgacgccgctgcccgacgccgcccctaatctggggatttctaacaagttcatccgtaggatctctgctagtgacccgcagacccagcagctggacttcgagggctccctgagggcgctgctgcaactcgagttccggctggagaagaataccgcctacgcgctgaccctgcatgtgataagggagaatcagtgaggctcgctggagctgctaatagaggactgccaggcccgcagagagctccctgatagcagacgtgcgcgcatgtcatcatctgatgtgtcacgtcggggactgtcccaactccccaatgcagtgctcacggcccggccaggctaataaaggcagcccccggctggcgatggaccttcaacgggggcccttgaaaggcgtttccacaaggaatgcctcctgttaccagaagaaatcggttgccttcgggatacggggatttggccagaggggtgggcccacaccttggcctgccttataaccccattaatatccctttcccggtgtccacccggat

SEQ ID NO: 89145 - protein, 57 aa, Zea mays
  misc_feature: Ceres CLONE 1576695
MATCYSDWTPIPPFLPSRRTPAHSHASPITITLQILSFALQCSRSCAPPPRALEPAR

SEQ ID NO: 89146 - DNA, 901 bp, Zea mays
  misc_feature: Ceres CLONE 1576696
  misc_feature: Encodes the peptide sequence at SEQ ID NO. 89147
aagctggagctccccgcggtggcggccgctctagaactagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcaacgccgtcgtcgttctcggcgctatcttgtcgtcgcctcggcgaccagagcccaaacggaagggcgccccctgtgacgatcgaggaacgtgggaactcaacttttcatcgagggcccgggccggaccaaccgggaagcttccccccgggggggggggggagggggcccccgggaaagcaaaaaactgggggagggggcttcgctgggaaccccccctggaaggggggggggctcctccccaagggaagccttatttccccgttaagggggaaaaattatttccccagggcccccctcaaaaaaagagagttttgaaaaaaaaaaaaaagcttttttttccccccttaataggggggaagatttgttaaaaaaacccccggggaaaaaaaaatttttttcccacaaaaatgggggcccctcgggggggaatctcggtaaaaaaagggaacaccccgctaatctctttaatccccccgggagaaaaaacccccagagtttccccaccaattgtggggggaatgaaaggaggccccacaacccccaaaaaatg

SEQ ID NO: 89147 - protein, 57 aa, Zea mays
  misc_feature: Ceres CLONE 1576696
MAATVSSCLSLVPTVHHRAGGFPSSVALTNTLQRRRRSRRYLVVASATRAQTEGRPL

SEQ ID NO: 89148 - DNA, 934 bp, Zea mays
  misc_feature: Ceres CLONE 1576700
  misc_feature: Encodes the peptide sequence at SEQ ID NO. 89149
ccccgcggtggcggccgctctagaactagtggatcccccgggctgcaggaattcgtctcacccctagaaaaacttcctcttccactccccaaccactccctccgcgccgatcgatccgtcccgtctgggaggcagctcgacgagagagagagagagagagagcgcgcgccaaggaattgacggttcgcggggaggaagcagagcagagcaggagaggagctgacgcggcggcggggccgagacggcgtggaggcatggacgggcacggcggcggggccggtaagctgacgcggacgccgtcgtcgctgctccgttcgccgaccgtccgcgcgggccccggcgccgcgtccttccacgccgtcctcgacgacccggagcccgacgacaagaaggcgcaggcgccgccccgggcgctgctccgccgggcccaccacaggctccgcccatgcccaacccaggccttgctccccctcctcttcctcccgcccctcgcgctcgccgcgcttgctcctgcgccgggggccgacggcgggcccccaccttggccctccctggcagccggcggcgggggtttcctgcttggcggggcgaccggccgccggaccgtcggccggcggtggggttcccccgggcgtcccgggccgacaccgggacccggcccctccgggggcaggggggtttcatccgggcgaaggggccgaaagggctagggaagcaagtcaacctaccggggaccaacgttcccccctccctaaggtttccgcggaagggggcctttccaggttttcttcaagactaactggggaaaccggtataatagggggggaaatatctccgcggggggggcggccctttcccagcgggaaagggggggggggtttcaaccatcttttctcccggggaatgggcgcaatttttgcaaggggggaaatgg

SEQ ID NO: 89149 - protein, 151 aa, Zea mays
  misc_feature: Ceres CLONE 1576700
MDGHGGGAGKLTRTPSSLLRSPTVRAGPGAASFHAVLDDPEPDDKKAQAPPRALLRRAHHRLRPCPTQALLPLLFLPPLALAALAPAPGADGGPPPWPSLAAGGGGFLLGGATGRRTVGRRWGSPGRPGPTPGPGPSGGRGVSSGRRGRKG

SEQ ID NO: 89150 - DNA, 961 bp, Zea mays
  misc_feature: Ceres CLONE 1576706
  misc_feature: Encodes the peptide sequence at SEQ ID NO. 89151
  misc_feature (756)..(756): n is a, c, t, g, unknown, or other
ctggagctccccgcggtggcggccgctctagaactagtggatcccccgggctgcaggaattcgtctcacccctagaaaaaacatggtgttgtcgggaaatttgttgagttctatgggcaaggcatgagtgaattgtcacttgctgatcgggcgaccatcgcaaatatgtctcccgaatatggcgcaactatgggtttcttcccagttgatggaaagacgctggactatttgaagcttactggccgaagtgatgatacagtggccatggttgagtcctacctgcgtgcgaataagatgttcgttgatcacagccaggctgaagctgaaagagtatattcttcttatctagaactgaacctggaagaggtagaaccatgtctatcgggaccaaaacggcctcacgatcgagtgacattgaagaatatgaagtctgactggctttcttgcttggatagcgatgtaggattcaagggttttgctgtccccaaagagtcacaaggcaaagttgcagaatttttgttccacgggactcctgcaaagataaagcatggtgatgttgtaattgcagcaataaccagttgcacaaacacatcaaatcctaatgtaatgctgggagctgctttggttgccaagaaggcttgtgagttaggcctggaggtaaagccatggattaagacgagccttgcacctggttctggtgttgtgaagcagtacttggataagagcgggttgcagaaatatcttgaccagcttggncttcaatatggtggctatggttgcacaacctgcattggaaatccggggagcttgatgaatcctatctgctgcattactgagaatgatattgtcctgctgctgtatgtccggaacagaattttgaaagacgtgtgctcccttactagagaaatacttgctcccccccatattggttgcttagcctggctggaccggttaattgatt

SEQ ID NO: 89151 - protein, 279 aa, Zea mays
  misc_feature: Ceres CLONE 1576706
  misc_feature (1)..(269): Pfam Name: Aconitase Pfam Description: Aconitase family (aconitate hydratase)
  misc_feature: SWISSPROT Homolog: EC 4.2.1.3 Aconitate hydratase
MSELSLADRATIANMSPEYGATMGFFPVDGKTLDYLKLTGRSDDTVAMVESYLRANKMFVDHSQAEAERVYSSYLELNLEEVEPCLSGPKRPHDRVTLKNMKSDWLSCLDSDVGFKGFAVPKESQGKVAEFLFHGTPAKIKHGDVVIAAITSCTNTSNPNVMLGAALVAKKACELGLEVKPWIKTSLAPGSGVVKQYLDKSGLQKYLDQLGLQYGGYGCTTCIGNPGSLMNPICCITENDIVLLLYVRNRILKDVCSLTREILAPPHIGCLAWLDRLID

SEQ ID NO: 89152 - DNA, 798 bp, Zea mays
  misc_feature: Ceres CLONE 1576709
  misc_feature: Encodes the peptide sequence at SEQ ID NO. 89153
ctcaccgcggtggcggccgctctagaactagtggatcccccgggctgcaggaattcgtctcacccctagaaaaactctttgctggctgcgccatcccttcgtagtctgcagtcctcaacgttcctaccagctgcgaccgcctgttaccagtgatgtctcccgtccttgccgctggcgtggagcccatggccgtcgacgattccgcctccaagaaggcgaagcacaaggatctcaaggcctccgccgccacctcggaggcaaaggctgaggccgcttctgccaggatgaaagagaagagagagaagaatctaaatgtgaaggagccgtcccctccgctaccataaaccgcgacctctgatgatgaagagaaaagcagcaccagctcccaggagacagcacccgccgcgaaaaaagcgaagaaggagaaaacaaaaaagaatgtcgatgtctcgtcatcaacctcaaatgaccatggcaagatcactgacagcagcgatgatgaccccacggacctcaacgcgctgagtatcttcaggatatcggaatccctgacgcagagtctcaggtcaaagtggatcaagtcactgatcaccattcaggccagcactttcgatctcaaactcgatagcagcgactatgttcggccgagcgcgcaccgagctagggaaaaaccttggcttattatcctcgcgcataatggcagtccttcggattaatgggggcaaacagggtcctctagaccggagtgaagaatgggcaggacccccaaggtgtttctcggttcaaacttaccaaaca

SEQ ID NO: 89153 - protein, 63 aa, Zea mays
  misc_feature: Ceres CLONE 1576709
MSPVLAAGVEPMAVDDSASKKAKHKDLKASAATSEAKAEAASARMKEKREKNLNVKEPSPPLP

SEQ ID NO: 89154 - DNA, 926 bp, Zea mays
  misc_feature: Ceres CLONE 1576711
  misc_feature: Translation starting site: 277
  misc_feature (726)..(726): n is a, c, t, g, unknown, or other
ctggagctccccgcggtggcggccgctctagaactagtggatcccccgggctgcaggaattcgtctcacccctagaaaaagcactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtgaggagggcagtctcctcaacagtatggggaatcgtggctgataagtatggaaggaaaccagttatcgtactgacccttattgcaatagttatcttcaatactatgtttggactaagctcaaactattggatggcattaatcacacgatgcctgcntggaatcatgtgtggttatctcgggccaattaatggctatgctacagaagtgtgcgaaaagaataaatcatctggcttttggcagttgtttcatcctcacgaggcattggtctcattagtggtcaagctcttggtgggtatcttgcgcagctgcagaataatatccagtatatctctcgacgtccatattttgggaggtt

SEQ ID NO: 89155 - DNA, 964 bp, Zea mays
  misc_feature: Ceres CLONE 1576712
ccccgcggtggcggccgctctagaactagtggatcccccgggctgcaggaattcgtctcacccctagaaaaagtctttgccggctgctccatcccttcgtagtctgcagtcctcatcgttcctaccaggtgtcaccgcctgttatcattgatgtctccccttcttgccgctggcctgcagcccttggctgtcgatgattccgcctccaagaaggccaagcacaaggatttcaaggccgccgccgccacctcctaggcaaaggctgaagccgcttctgtctggattaaagagaaggaaagagaagaatcgaaaggtgaaggagccgtcccctccgctaccatcaaccgcgtcctctgatgaggaatagaagagcagcaccagtctcccaggagacagcaccccccgtccaaaaaaagcgaagaatgagaaaacaaaaaagaatgttttattgtctcgacatcaacccccaaaatgacgatgtggaagatcaccttccccggcaaccgatggaggaacccccgcgggaccatgaacgccgcgtgacgcaactttcagggaatatcgggagatcccttgaaggaagggaggccctctagggtcccaggggggattcgaggcctcttggtttccacccatttaggggccatccaacgtttgaatatttcaaaaactggggaggggccagtctaattttggttttgggccaaagacccccgctcccgggtccggggaaacaaaccttttgggagtttggttcccttggcgccaaaaagtgggaggtctcttagagttgacgcggggccaaaaacggggggtctcctaatcccgtgatgggaaaatggcgcgcggcccccccaaaggtttgccgcggtttaattttcacaagagaagaagctgggcccctcggggaggccgaagggcagaattttagttgtttatggggcgcccaatgttggggggctcc

SEQ ID NO: 89156 - DNA, 846 bp, Zea mays
  misc_feature: Ceres CLONE 1576713
  misc_feature: Encodes the peptide sequence at SEQ ID NO. 89157
ctggagctccccgcggtggcggccgctctagaactagtggatcccccgggctgcaggaattcgtctcacccctagaaaaaaagcgcaccaccaccaccaccaccaggatagatatcatcagatcaccaaccagtgcagcaaaagaaagaaagaaagaaagaaaagaaaaaggcaggcgcgccaaaatggacaacggcggcagcaacggctccgccaccgcctccgcctgctgcaacggcaaaattaaccgcgggccgcacgtggcgatgctggcgacgcccgggatggggcacctgataccgctggcggagctggcgaagcggctggcgtcacggcacggcgccacggccacgctcatcacgttagcgtccacggtgtcgcccacgcagcgcgcgttcctggcctcgctcccgcccgaggtgtcctcgctgtacctcccgcccgtcgacctctccgacctgccccgcgccgcagacatcgagactcgcatgtctgaggagtgcgcgagctcggtgccggcgctgacggccgtcctctccgacctcaagaagatcaccgacgggcacctgtcggtcgtcgtggtcaaactcttcggagtcgactcgctggactcggcccgctcctcggggggtccaccgcatgtgcatctttcttccatccaaacctgaaggtgctcacggcttatcctccacctgacgggacctgggaatcggtcgagggccgggggcggttccggggacttgcccgtatccggctgcaaccaggccccggggtggcgtggccttgtcccgggggtgcccttaacctggttccattgccgttttggaagtaaaaggggcgcaaccc

SEQ ID NO: 89157 - protein, 160 aa, Zea mays
  misc_feature: Ceres CLONE 1576713
  misc_feature: SWISSPROT Homolog: EC 2.4.1.218 Hydroquinone glucosyltransferase
MDNGGSNGSATASACCNGKINRGPHVAMLATPGMGHLIPLAELAKRLASRHGATATLITLASTVSPTQRAFLASLPPEVSSLYLPPVDLSDLPRAADIETRMSEECASSVPALTAVLSDLKKITDGHLSVVVVKLFGVDSLDSARSSGGPPHVHLSSIQT

SEQ ID NO: 89158 - DNA, 773 bp, Zea mays
  misc_feature: Ceres CLONE 1576721
  misc_feature: Encodes the peptide sequence at SEQ ID NO. 89159
ctggagctcaccgcggtggcggccgctctagaactagtggatcccccgggctgcaggaattcgtctcacccctagaaaaaggacgcttcgctctagtcggaaggtttcgaggaactcccgggcccgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaaacaagttcatttcatccttaagcacaagaatcctaagactggaaagtatgttgagcatcacctcaaaatcccaccttctgtcccatacgacaggctctctcatgtctacacagctatcttgaaagcagaacatgaagtcagaattttgatcgatgggggaagaaagaagaaaggcgaacttccctttctgctgatgactttgaaccca

SEQ ID NO: 89159 - protein, 211 aa, Zea mays
  misc_feature: Ceres CLONE 1576721
  misc_feature (24)..(211): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTKQVHFILKHKNPKTGKYVEHHLKIPPSVPYDRLSHVYTAILKAEHEVRILIDGGRKKKGELPFLLMTLNP

SEQ ID NO: 89160 - DNA, 854 bp, Zea mays
  misc_feature: Ceres CLONE 1576723
  misc_feature: Encodes the peptide sequence at SEQ ID NO. 89161
  misc_feature (613)..(613): n is a, c, t, g, unknown, or other
  misc_feature (704)..(704): n is a, c, t, g, unknown, or other
atagctggagctccccgcggtggcggccgctctagaactagtggatcccccgggctgcaggaattcgtctcacccctagaaaaactctgctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtagctctttagggttcgcgatttctcgccgatcggttcgagaattggtaagctatggatctctcgcggcccacatcgtcagacctctcgctcgggctccactctcacggtcacgcccacgcccacgctcgcaggcacgcggtagccgcgccgctgcgcctgttcgacgacgcggaggagccgaagccggagcgcgtcgtggccggagaggccgacgcggagagggatgacgaggacgggggcgaccagcacttctccctcctcgggcactccctcttcgtcaagcgcccgcgccgcgccggcaacngcggcgggggcggagagacgtcatcctgctcgtccacgttcgcggggctttcgcctgccaagcgacaggcgacgggggaagggcagcggcncaaatctggaaacccgccgcgccgccggtccgcggctgggggcaatcattcgctggcgggaaggcgaccccgaaactgcactcgcttaatggaaccagaaatttggaccgccccggtgcgaaaggaatccgagctccaaagcggtcggac

SEQ ID NO: 89161 - protein, 164 aa, Zea mays
  misc_feature: Ceres CLONE 1576723
  misc_feature (85)..(85): Xaa is any aa, unknown, or other
  misc_feature (115)..(115): Xaa is any aa, unknown, or other
MDLSRPTSSDLSLGLHSHGHAHAHARRHAVAAPLRLFDDAEEPKPERVVAGEADAERDDEDGGDQHFSLLGHSLFVKRPRRAGNXGGGGETSSCSSTFAGLSPAKRQATGEGQRXKSGNPPRRRSAAGGNHSLAGRRPRNCTRLMEPEIWTAPVRKESELQSGR

SEQ ID NO: 89162 - DNA, 1006 bp, Zea mays
  misc_feature: Ceres CLONE 1576724
  misc_feature: Encodes the peptide sequence at SEQ ID NO. 89163
aaagctggagctccccgcggtggcggccgcactacaactagtggatcccccgggctgcttgtcttcgtctcacccctagaaaaagacccccttccccctgacgcctcgcgaagccatcatcttccaaaccctcgccgcagccgcagccgcagccgcagccacccttgcttccgcacgatagtgcccgggaccagccttctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttacttgggattggatttggggacaactaaactcttgtgttgcctgccaccccaaggaagaaaccccaaagttatttgagaaatgctttaaaggggcgagaaacaaacaccatccggttgtccgcatttaactcagaaagggtgaaaaaactttgttggggaacccccgcccaaagcgccagggcaggtaaacccaatcccccccgaaatacttttttttttgggaaccaaaagaaaggaaaaaattgggggccaaacactttttggatggattccccccgggacccccccaaaggaaagagtagaaagaagggggggcccactaacaaaaaatttcttgggaaaggggcccacaaaagggggggaaacgcctttggggttgtgaaaaaaaacaaaggggggcaaggccagtcttctctccccgagggccggggggcgggggacatttttgggtcctaacaaaacaagaaaagagaaacaacgtaaaaatttctaccttgggggaaaaaattgctttcaagaggggggaggatccgcggttccgccttattttaaaaagagccccccgcgccggcgcccaaaaagggggggggggctttattgggggcctttggttgtaaaggggtacctccgagcacccccgccc

SEQ ID NO: 89163 - protein, 96 aa, Zea mays
  misc_feature: Ceres CLONE 1576724
MAASLLLRAVRRRELASPLGSLGANLQSTCAANICSKWGNFARPFSAKAAGNEVTWDWIWGQLNSCVACHPKEETPKLFEKCFKGARNKHHPVVRI

SEQ ID NO: 89164 - DNA, 866 bp, Zea mays
  misc_feature: Ceres CLONE 1576725
  misc_feature: Encodes the peptide sequence at SEQ ID NO. 89165
  misc_feature (20)..(20): n is a, c, t, g, unknown, or other
  misc_feature (45)..(45): n is a, c, t, g, unknown, or other
gaagggtgggtgattttagnaggagagggggagggataaactagnaaacggaagagggtggggggggggggggggggggggggcaaagctggagctccccgcggtggcggccgctctagaatagtggatcccccgggctgcaggaattcgtctcacccctagaaaaaagtcgcacaacgcgcctccctgctccagttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgccatcgatcgtccgcggcaagcggtgcccgatgcgccggccgtctacttcgtccggcccacccccgggaacgtggaccgggtagcggccgacgccgccgcggggctctacgggtctttccacgtcaacttctccacctccgtcccgcgacccctgctagagcgcctcgcaaccgcctgcgccgccgctccgcccgcgtgtgcgggcccgcgtgagcgcgccgttgctggaccaggtacatcggacttcgttctgcaatcggagggatgaaccttctttttcccttaagcgcaagcccccggggccctacgttcgcaacttcaaacggaacccccgccccgcctgcccggaacgccccatacattcaacttggccccctcggtccgaaactcccggttcc

SEQ ID NO: 89165 - protein, 157 aa, Zea mays
  misc_feature: Ceres CLONE 1576725
MTLSLRRKQLDVIVRMLHLNQQQLPNGGEGQGEDDAYKILVMDPPCISILSPVLKLGDLRHQGVTLTLAIDRPRQAVPDAPAVYFVRPTPGNVDRVAADAAAGLYGSFHVNFSTSVPRPLLERLATACAAAPPACAGPRERAVAGPGTSDFVLQSEG

SEQ ID NO: 89166 - DNA, 882 bp, Zea mays
  misc_feature: Ceres CLONE 1576727
  misc_feature: Encodes the peptide sequence at SEQ ID NO. 89167
  misc_feature (790)..(790): n is a, c, t, g, unknown, or other
  misc_feature (872)..(872): n is a, c, t, g, unknown, or other
tggagctccccgcggtggcggccgctctagaactagtggatcccccgggctgcaggaattcgtctcacccctagaaaaactccgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggctgcgctccggggtggtgcggtgcgacgccgccggcgtggaggcccatgcgcatgccgtggcaaaggcggccagcgtcgccgccctcgagcagttcaagatatccgccgaccggtacatgaaggaaaggagtaccatagctgtgataggcctcagtgtacacacagcaccagtggagctgcgtgaaaaacttgctgttgcagaggaactgtggccccgtgctattcaagaactcactagcctgaaccatattgtagaggctgctgttcttagtacctgtaatagaatggagatctatgtggtggcgctatcatgggaccgtggtatcagagaagtagtggactggatgtcnaagaaaagtggtagtccccgctccgagcttaggtagcacctgctcatcttggcgagcaggatgcacacgccatctgtttganggtcagctgc

SEQ ID NO: 89167 - protein, 164 aa, Zea mays
  misc_feature: Ceres CLONE 1576727
  misc_feature (85)..(164): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
MATTTSATTAAAAAATTAKPRGSSSALCQRVAGGGRLRSGVVRCDAAGVEAHAHAVAKAASVAALEQFKISADRYMKERSTIAVIGLSVHTAPVELREKLAVAEELWPRAIQELTSLNHIVEAAVLSTCNRMEIYVVALSWDRGIREVVDWMSKKSGSPRSELR

SEQ ID NO: 89168 - DNA, 819 bp, Zea mays
  misc_feature: Ceres CLONE 1576729
  misc_feature: Encodes the peptide sequence at SEQ ID NO. 89169
ggagctccccgcggtggcggccgctctagaactagtggatcccccgggctgcaggaattcgtctcacccctagaaaaaaggacccaaatgccccactcttattacctgctaattttgaatttcctaatcaggttgcagctgcttatataagctcactgaccccgcgttcgctttctccgactcccacctccagccaaatcggcctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggccccagggcaccaccaacgtcggccgctacagcatggggggagcccacccagtgatgggagattgtggccaaaggaccacaagttacgatcatgggaccacgagaaaagcaagtgaacagagccggtaatgggacgaccccattgcagatcccgaggaccattgatggaggggagggcacccacag

SEQ ID NO: 89169 - protein, 170 aa, Zea mays
  misc_feature: Ceres CLONE 1576729
  misc_feature: SWISSPROT Homolog: EC 4.1.3.27 Anthranilate synthase
MESLAATSVFAPSRVAVPAARALVRAGTVVPTRRTSSRSGTSGVKCSAAVTPQASPVISRSAAAAKAAEEDKRRFFEAAARGSGKGNLVPMWECIVSDHLTPVLAYRCLVPEDNVDAPSFLFESVEQGPQGTTNVGRYSMGGAHPVMGDCGQRTTSYDHGTTRKASEQSR

SEQ ID NO: 89170 - DNA, 1075 bp, Zea mays
  misc_feature: Ceres CLONE 1576730
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (449)..(449): n is a, c, t, g, unknown, or other
nnnnnnnnnnnnnnnnnnnnnnnnnnnnnnnnnnnnnnnnnnnnnnnnnnnnnnnnnnncccccccnnnnnnnnnnnnnnggggggnnnnntcaaactggagctccccgcggtggcggccgctctagactagtggatcccccgggctgcaggaattcgtctcacccctagaaaactccgtctcgtctcccaggtcatggcaaaagctggagcaccgggaaaaatagcaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcntggattctcctgcagcagaacggggaccaggaactggggctccgcttccctaatgcccgaagacgttcttcctgggaaccaattccttgatgggggaaaggggggtcctttgtgggaacccccccccccgaaaaagtttccccggaaccccttggggggaaacaaacccccgcattacacccaccttttgagggaccatctcgggaaacttgggggccccccccccctttgtgggcccccccccccccccttaaaaattttaaaaaccgcgttttcatgggggaacttttctacccaaaaaaaaccccccccccgaaaaggagattccctctttttgttttataagggggggggggggggggccttatctccaccaaaaggggttttttttctccaacacaaaagaggggagagtctcccccctgagaacaaacggccccccccctccccacaaaaaaaaaaaaattatctccccgcccccccccccgagagaagaaaaatccccctccccccacaaaaaatattcctcccaaaaaaaaaaaaaaagagagaggggtggtgtccccccccccccacccacagaggagggttgttttttttctttgggagaagaggaatccctcccc

SEQ ID NO: 89171 - DNA, 878 bp, Zea mays
  misc_feature: Ceres CLONE 1576731
  misc_feature: Encodes the peptide sequence at SEQ ID NO. 89172
  misc_feature (878)..(878): n is a, c, t, g, unknown, or other
aagctggagctccccgcggtggcggccgctctagaactagtggatcccccgggctgcaggaattcgtctcacccctagaaaagttgcgctgccgggaactgtggccaccgggcccgccgccggacccccggtgttctcctcgccggcgatgtcggcgccgcctgtgcgtacgctcgccgaccttgatggcgacgtgctggctcactgcgccggctacctcggcgcccgcgacgtcgccagcctcgccatggcctgccgccccctgcgcgccgccgcctattgcgacgcggtctggtaccgcctcttcagggatcaatggccatttgagaaagtgccttgtgatgctttggggctaagagaactatacatccatagacacactgaaatacatcagatgaaatttgcccaccccatatcagctctttattacttagatcctgcgggaacaacaccaagtcatgtaatgctggataggaactccatctggttttgtcaaggtccagcagccaaaaaactgaatattgatttgccagaaactgaaattgtagaaacacacaggaaccatagtgcaaggatcacttgtctgaggtaactgaaaacgaataactgttgcagtattgttcattctcatgtaatcataattattcttaatctgtgaggagaattaagggttgaaaaattaaggcttttgatttttattgccaactataaaaccatggaccaggagagttaaaggttttatggtttttaccggccttaatatttaaaagttaaatatttaatccctggtccctttttcccgttaaaaccatgaagtctctctcaatttgtctcccatggtggtcctcccaaattacacaccttaccgggggccttan

SEQ ID NO: 89172 - protein, 147 aa, Zea mays
  misc_feature: Ceres CLONE 1576731
MSAPPVRTLADLDGDVLAHCAGYLGARDVASLAMACRPLRAAAYCDAVWYRLFRDQWPFEKVPCDALGLRELYIHRHTEIHQMKFAHPISALYYLDPAGTTPSHVMLDRNSIWFCQGPAAKKLNIDLPETEIVETHRNHSARITCLR

SEQ ID NO: 89173 - DNA, 893 bp, Zea mays
  misc_feature: Ceres CLONE 1576732
  misc_feature: Encodes the peptide sequence at SEQ ID NO. 89174
ctggagctccccgcggtggcggccgctctagaactagtggatcccccgggctgcaggaattcgtctcacccctagaaaaaagtttctgtagtctcggctgcgagcctgacccagacagacacacaccagagggagagggagacggagagaagggcgagcggcactagcaagcatggcggcggccgtcctagcgcccaagccgcctccttcgctgcctaccagggcctttccttcctcatccccctcgcggtttgcccctgccttcatctccccgcgtcatcccctgagaagattgctcctccgccccattccgtgcgcctcatcgccgtcttccgtcttgatgccgaacccggacctcgagactgagcctgcccacgatggagatggagatggagatgaggcgccgccggagtccaggccccgccgcatcgcccttttcgtcgagccgtctcccttcgcctacgtctccggctacaagaaccgcttccagaacttcatcaagtacctacgggagatgggcgacgaggtgattgtggtcaccacgcacgagggcgtgcctcatgaattccacggagccaagctaattggctcatggagcttcccttgcccctggtatcaaaaggttccgctgtcgctggccctcagtccctcgatcatcgcagaagttgctagattcaagcctgacattaattcacgcctcttcccctgggattatgggtatttgggcgcggcttatcattgcaaaagttgcccctgccccccctctgggtaatggtctttccccaaacccccgtttccagttttttttcccccaaattaccttttcaggcggggttgtggaaagcccccgggggggcgaaaaaaaaaaaaattttgggccccaaacccctcac

SEQ ID NO: 89174 - protein, 143 aa, Zea mays
  misc_feature: Ceres CLONE 1576732
MPNPDLETEPAHDGDGDGDEAPPESRPRRIALFVEPSPFAYVSGYKNRFQNFIKYLREMGDEVIVVTTHEGVPHEFHGAKLIGSWSFPCPWYQKVPLSLALSPSIIAEVARFKPDINSRLFPWDYGYLGAAYHCKSCPCPPSG

SEQ ID NO: 89175 - DNA, 808 bp, Zea mays
  misc_feature: Ceres CLONE 1576733
  misc_feature: Encodes the peptide sequence at SEQ ID NO. 89176
ctggagctcaccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactgggacctgctgggcaacaaacttcccgtcttcttcatccgcgacggcatcaagttcccccgacgtgatccacgcgtttcagcccaacccgcggtcgcacgtgcaggagtactggcggggtgttcgacttcctgtcgcacctcccccgagagcgtgcacaacttcttctttctcttcgacgaacgtgggcgtgccgtccgaactacggcaccatgaaagggttcggggtgaacacgtacaacgtcggggagcccggcgggg

SEQ ID NO: 89176 - protein, 203 aa, Zea mays
  misc_feature: Ceres CLONE 1576733
  misc_feature (18)..(204): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNKLPVFFIRDGIKFPRRDPRVSAQPAVARAGVLAGCSTSCRTSPESVHNFFFLFDERGRAVRTTAP

SEQ ID NO: 89177 - DNA, 772 bp, Zea mays
  misc_feature: Ceres CLONE 1576737
  misc_feature: Encodes the peptide sequence at SEQ ID NO. 89178
  misc_feature (713)..(713): n is a, c, t, g, unknown, or other
ctccccgcggtggcggccgctctagaactagtggatcccccgggctgcaggaattcgtctcacccctagaaaaagcgagcaaagtatcggtgcctatatacctcattattttcagtccgagtggcgaaacacgccgcagcttccactgaccactgctccacaggctcatatccgattccgatcctaagacctcagctgctgcggcatccacggccaactcaagcgctggcaactggcaagggcagatgatctgtgtatagcactcgctaccatctcttgatttccccctcaggtcgctgaccaagggtcctgtcctgcctggagccgtcgacacccgggtggccagcgattgctttgctgctccaggaaagaagccaaaaaaaaaaacgaagaattaaacatcgattgaaagggaaaagacaatgccaagcctaaactgagaggcgcacactggatttcgcatcagttcatgtcgttccttacaccgtcaaatttgacgaatcacctcgccacgccttgattttgttttgtcctccgcttctggccgggctcagttcagctgtatggtattggtatcgccatgtcaagcgacctctccacacgctcctcgccttcctcctccaccgcgtcgccttccgacgactcgcggcggcaggagcaaggccaggcggcgggtaacgccagcgggagccggcggtggcggtggcgcctcnggctgggcgcggcgtgggcgctggacccgcgcgcgaggtgggtccgggactggaaccgc

SEQ ID NO: 89178 - protein, 64 aa, Zea mays
  misc_feature: Ceres CLONE 1576737
  misc_feature (45)..(45): Xaa is any aa, unknown, or other
MSSDLSTRSSPSSSTASPSDDSRRQEQGQAAGNASGSRRWRWRLXLGAAWALDPRARWVRDWNR

SEQ ID NO: 89179 - DNA, 835 bp, Zea mays
  misc_feature: Ceres CLONE 1576740
  misc_feature: Translation starting site: 157
  misc_feature: SWISSPROT Homolog: EC 1.4.1.2 Glutamate dehydrogenase
  misc_feature (618)..(618): n is a, c, t, g, unknown, or other
  misc_feature (728)..(728): n is a, c, t, g, unknown, or other
  misc_feature (774)..(774): n is a, c, t, g, unknown, or other
  misc_feature (808)..(808): n is a, c, t, g, unknown, or other
gctccccgcggtggcggccgctctagaactagtggatcccccgggctgcaggaattcgtctcacccctagaaaaatcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttncatgactcacagaggcaggccacaaaggatgctgggggtgattgctggcctttatgtgctgcgtatcatcaacgagccaacagctgcagctatcgcctatggtcttgacnagtaggctaccagtgtcggtgaagagaatgtcctcatccttgatcntgggaggtgtaccttttgatgtctccctcctcancattggaggaagaaatcttgaggtcaa

SEQ ID NO: 89180 - DNA, 820 bp, Zea mays
  misc_feature: Ceres CLONE 1576743
  misc_feature: Encodes the peptide sequence at SEQ ID NO. 89181
  misc_feature (71)..(71): n is a, c, t, g, unknown, or other
  misc_feature (73)..(73): n is a, c, t, g, unknown, or other
  misc_feature (110)..(110): n is a, c, t, g, unknown, or other
  misc_feature (501)..(501): n is a, c, t, g, unknown, or other
  misc_feature (514)..(514): n is a, c, t, g, unknown, or other
  misc_feature (515)..(515): n is a, c, t, g, unknown, or other
  misc_feature (522)..(522): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (535)..(535): n is a, c, t, g, unknown, or other
  misc_feature (536)..(536): n is a, c, t, g, unknown, or other
  misc_feature (557)..(557): n is a, c, t, g, unknown, or other
  misc_feature (568)..(568): n is a, c, t, g, unknown, or other
  misc_feature (569)..(569): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (644)..(644): n is a, c, t, g, unknown, or other
  misc_feature (648)..(648): n is a, c, t, g, unknown, or other
  misc_feature (676)..(676): n is a, c, t, g, unknown, or other
  misc_feature (699)..(699): n is a, c, t, g, unknown, or other
  misc_feature (708)..(708): n is a, c, t, g, unknown, or other
  misc_feature (709)..(709): n is a, c, t, g, unknown, or other
  misc_feature (723)..(723): n is a, c, t, g, unknown, or other
ctcaccggcggtggcggccgctctagaactagtggatcccccggggctgcagggaaattcgtctcaccccntngaaaaaaaaaaaaaaaaaaaaaaagaagagcacgccncactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgcggcggcggcggagctggcggggagccacctggacgaggtgaagcgcatggtggcgcaggcccggcagccggtcgtgaagatcgagggatccacgctccgcgtcggccaggtggccgccgtcgcgtccgccagggacgcgtccggcgtcgccgtcgagctgtattctgcagctgtgcctgcgtcccgacaagcggaaagaagaggcggggagggagggaaagtanaaaaagggggaannaaaggananngnnaagaggnnagagaaaaaggggagggaggnagagagggaanngggagnnnaaggaagggagggaaagggagaaaaaggaagggggaaaaaaaaananngaaggggaaagggaaaaangagngaaaagggaggaagaaagggggggaaangaggaaggaaaggaaaaagaggnaaaagagannagggggaaaggganaggaggggagaggaaaaagaaaaaaggaaggaggagagaaagaaaagggaaagggggggaaaaagggaaaagaaggggggggagaggaaaaagagga

SEQ ID NO: 89181 - protein, 197 aa, Zea mays
  misc_feature: Ceres CLONE 1576743
  misc_feature: SWISSPROT Homolog: EC 4.3.1.5 Phenylalanine ammonia-lyase
  misc_feature (92)..(92): Xaa is any aa, unknown, or other
  misc_feature (96)..(96): Xaa is any aa, unknown, or other
  misc_feature (99)..(99): Xaa is any aa, unknown, or other
  misc_feature (100)..(100): Xaa is any aa, unknown, or other
  misc_feature (101)..(101): Xaa is any aa, unknown, or other
  misc_feature (103)..(103): Xaa is any aa, unknown, or other
  misc_feature (114)..(114): Xaa is any aa, unknown, or other
  misc_feature (116)..(116): Xaa is any aa, unknown, or other
  misc_feature (117)..(117): Xaa is any aa, unknown, or other
  misc_feature (132)..(132): Xaa is any aa, unknown, or other
  misc_feature (133)..(133): Xaa is any aa, unknown, or other
  misc_feature (139)..(139): Xaa is any aa, unknown, or other
  misc_feature (141)..(141): Xaa is any aa, unknown, or other
  misc_feature (150)..(150): Xaa is any aa, unknown, or other
  misc_feature (158)..(158): Xaa is any aa, unknown, or other
  misc_feature (161)..(161): Xaa is any aa, unknown, or other
  misc_feature (166)..(166): Xaa is any aa, unknown, or other
MAGNGAIVESDPLNWGAAAAELAGSHLDEVKRMVAQARQPVVKIEGSTLRVGQVAAVASARDASGVAVELYSAAVPASRQAERRGGEGGKVXKGGXKGXXXEXREKGEGGREGXGXXRKGGKGRKRKGEKKXXKGKGKXEXKGRKKGGEXRKERKKRXKRXGGKGXEGRGKRKKEGGEKEKGKGGKKGKEGGGEEKE

SEQ ID NO: 89182 - DNA, 824 bp, Zea mays
  misc_feature: Ceres CLONE 1576746
  misc_feature: Translation starting site: 154
  misc_feature: SWISSPROT Homolog: EC 1.4.1.2 Glutamate dehydrogenase
ccccgcggtggcggccgctctagaactagtggatcccccgggctgcaggaattcgtctcacccctagaaaaatagaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcaacacgaccgcgtcgagatcattgccaacgaccagtgtaaccgcaccacgccctcgtacgtcaccttcaccgactccgagcgcctcatcggagatgcggccaagaaccaggtcggcatgaaccccatcaactccgtctttgatgccaagcgtctcatcggcaggaggttcatcgatgcgtctgtccagagtgatatcaagttgtggcccttcaaggtcatttctgggcctggtgagaagccaatgattgtcgtccagcacaacggtgaggagaagcagtttgcaactgaagagatctcctctatggctcttatcaagatgcgtgagattgctgaagcttaccttgctagcacgatcaagaatgctgtggtcacagtccctgcctacttcaatgactcagagaggcaggccacaaaggatgctgggggtgattgctggacctaatgtactgcgtatcatcaacgagcccacagctgcagctataggcgtacggcttgacaataaggctaccagtgtcggggaagaagaaggtcctcatcttttgatcttggagggggtaccttgtgatggtccccctacctcccctctgaagaaaggaa

SEQ ID NO: 89183 - DNA, 841 bp, Zea mays
  misc_feature: Ceres CLONE 1576747
  misc_feature: Encodes the peptide sequence at SEQ ID NO. 89184
tggagctccccgcggtggcggccgctctagaactagtggatcccccgggctgcaggaattcgtctcacccctagaaaaacctctcctgtcctgtcgttctcgtgcatgctcacggtcccccacgcccacgagcgcctccgcggcgacgaagagaatcatcaggcagagcgggggtggggcggggcgcagatggatctagagaggtcaccgccagcgtcgtcggcggaggcgcccggggacggcggcgggggcggggccgcggcctgctcaatctgcctggatgcggtgctcgcccgcggcgctggtcgctccgtcgccaagctacaatgcggacacgagttccacctagattgtattgggtctgcattcaatgcaaaaggagcgatgcaatgccctaactgtcggaagattgagaaaggtcgctggctttatgcaagcggacatcgcgcctctgttgatattgatatgggtggctgggtgaccagtgacaactatgatatcacctccgagcttccttttggatttcaatggtgcccctttagtggattcacccggctagcatccatgtttgaggagcgtgaagctgagcttacttatcacacaactggagatcgctcaagtgctgcaagcagttcacttgtttgcccatatcttgcccctgcgtggttttctgcatcctgttcatgtgccttctacatctaatcctggtgctgaaagcacttcatttcgtcggcatgcaactggcttggaaggcatgccactcttgatttgaatatgctcaacttttccatgcgaatgagtcaataaatcatgacagtgagcacagacatttggagtaatc

SEQ ID NO: 89184 - protein, 198 aa, Zea mays
  misc_feature: Ceres CLONE 1576747
  misc_feature (54)..(99): Pfam Name: zf-C3HC4 Pfam Description: Zinc finger, C3HC4 type (RING finger)
MLTVPHAHERLRGDEENHQAERGWGGAQMDLERSPPASSAEAPGDGGGGGAAACSICLDAVLARGAGRSVAKLQCGHEFHLDCIGSAFNAKGAMQCPNCRKIEKGRWLYASGHRASVDIDMGGWVTSDNYDITSELPFGFQWCPFSGFTRLASMFEEREAELTYHTTGDRSSAASSSLVCPYLAPAWFSASCSCAFYI

SEQ ID NO: 89185 - DNA, 931 bp, Zea mays
  misc_feature: Ceres CLONE 1576749
  misc_feature: Translation starting site: 194
  misc_feature: SWISSPROT Homolog: EC 1.4.1.2 Glutamate dehydrogenase
  misc_feature (765)..(765): n is a, c, t, g, unknown, or other
  misc_feature (811)..(811): n is a, c, t, g, unknown, or other
  misc_feature (825)..(825): n is a, c, t, g, unknown, or other
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaagggatgctggggtgattgctggcctcaatgtgctgcgtatcatcaatgagccaaccgctgctgctattgcctatggtcttgacnagaaagcaaccagcgtcggtgagaagaatgtcctcatctttgaccntggaggtggtaccntcgatgtctccctccttacttatgaggaaggtatcctttgagtcaggccacagctggcgacacccatcttggggggtgaggactttgacaacaggatggtcacccc

SEQ ID NO: 89186 - DNA, 1333 bp, Zea mays
  misc_feature: Ceres CLONE 1576752
  misc_feature (57)..(57): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (475)..(475): n is a, c, t, g, unknown, or other
  misc_feature (476)..(476): n is a, c, t, g, unknown, or other
  misc_feature (499)..(499): n is a, c, t, g, unknown, or other
  misc_feature (968)..(968): n is a, c, t, g, unknown, or other
  misc_feature (1187)..(1187): n is a, c, t, g, unknown, or other
aaagtggggttaatttcccgaaaaacagggagccactaaatatcacacccccccaanacccccnnnnnnnccaaactggaactccccccggtggcggccgctctagaactagtggatcccccgggctgcaggaattcgtctcacccctagaaaaaccatctctgaggctgccgccagccaccggccagcgtcgttcgctttgtagcagtccagctctgcgcccggcgccgcagccccgcatcgcgcacaggcacaacttctacggtcctgccgttgatcgccgcacgtggccgcgccgccgcctccctcacccgagctcgaccgcgcttctccagctcgccgcctcgacggtcgctgcctcgacacctcccccgcgtgggcatcagccgggagcagagagccctggtccctggaggcgcgtcgcgttacggcgggggcgcggcctccccagccccccttggtgataggtgcaccnnccatcgcactccccacccacaancttgcactcctgcacggattgcgcgcccaaccgcccgtgcccggtgggcggcgggcgacccggcgaacgggtcagcccccccgacaagtcagggaccttccggacttccgggacactcccccccctcagacaccctctctggatcccgtattccaggttcccaagatttcgagggctttgaaaaaggttttggaaaaaccaaccacaggtcaacggaataatttttttgtggaaaagatagactgccccccgtgtccctagcgatgaaaattttccttttctcggaccccacatgtgtgtatgaggagaagagagggggattgttacataaggttttgtacagggtgcgcgggatagaagggaaaagcatgtatcgtagatctttttactagatgtttgggataaaaacaccacacggggctaagggctccttacctcacagtgattcgcgcgcgcaagatcgccacgncaaaaagggggcgggagatattttctatattgtgcgggccccgacaatatatgaaaaaggcttgggggctaggagcacttttggctggttttgtgggtttcacacacacgcgattatatgcgcccgccccgcaccgacgacgtactcacgttctctaagaggtggggggggcggccatcggtatcattaccattgtcacgcctccccccttctgtatcnattcatctcacttgggattattatggggagagataaacatatccactgctcctacaacacagggtagcggctcatctccgggcgagtggccttcctctcatcgatgcgtatggaacactcttccgtggtctgtgaaaagatgtcaa

SEQ ID NO: 89187 - DNA, 815 bp, Zea mays
  misc_feature: Ceres CLONE 1576754
  misc_feature: Translation starting site: 385
  misc_feature (557)..(557): n is a, c, t, g, unknown, or other
  misc_feature (775)..(775): n is a, c, t, g, unknown, or other
  misc_feature (801)..(801): n is a, c, t, g, unknown, or other
ctggagctccccgcggtggcggccgctctagaactagtggatcccccgggctgcaggaattcgtctcacccctagaaaaaactcacttcgtcacagtacgccgcaaagacatcagcccagccttccccaattccggccacaccccccgctacgcctgtgctgccgcctccccttcctcttcgcttcccgtgcaagcttcaccgccgccatctcgtcctctcgtcgcgatgcttccccttccgcgccgcggttcctctatccccgccttccctgcccgctccggctcttgcacctgacccagtccgccaatctgttccccttttccgtacgagggtactatcgccggccatttcgattcggggttgatcggatcagcgtaggctgatgggtcgcgatgctgagaagacctctccgccggtgccatcgtcggaattggaacaggaagaagacgacgactgctacctaagcgatcaggaggacgatgccctagaagagtccgttctccatgtcctcgaggacgagcacctcgaggactgccattggtccgcctcatgcgntgatcaccaaggaatccctcttggcagcgcagaaggaagatcttaggaaggtgatggagctgctaggggtgaaggagcacccatgccggacgctcctcatccactaccgctgggacgtggagaggatttttgagcttctcgatcagaagggagggatagcctcttctcggaagctggtattccctctcagtacaccaatatgctgggcccaacctccntcagcgaaggtgacctggcaaggttngttatgatgaaggt

SEQ ID NO: 89188 - DNA, 783 bp, Zea mays
  misc_feature: Ceres CLONE 1576755
  misc_feature: Encodes the peptide sequence at SEQ ID NO. 89189
ctccccgcggtggcggccgctctagaactagtggatcccccgggctgcaggaattcgtctcacccctagaaaaaaaaatcactcccaccgtctccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtgcctggcgttcccaccccctgccacctcgcccgctcccggctcctcccccctcggccgtcctgctctggtcgcggcggagccgccagatctgggccacgggtgccagcccagccggcgggcggcgggacggagggctgcgggatgaagtcgtcgctgaggagccggcaggagccgcggcgggtcagcaacggcgtcatcatcggcgccatgctgctatccctctgcgtcctcagcatcgtcaaggccagatactgcgccacccccttcggcaaggccgatgaccagctccaggagcagatgaactccagcatccggatggagccggatgagtcgtctccggccaggtacgcccggtagagatgaggaggaggacgacggatagaatggggcgtcggccaccaccaccacggctgcccgcggtgacgtaaacgccggcgtgccgtcgcggccggctggcacaggggcaatggctagccc

SEQ ID NO: 89189 - protein, 171 aa, Zea mays
  misc_feature: Ceres CLONE 1576755
MGGGMEVHKNRWIEEWNAGRENLEFNFRWTRRSLAVVGLFGLAVPILVYKGIVPGVPTPCHLARSRLLPPRPSCSGRGGAARSGPRVPAQPAGGGTEGCGMKSSLRSRQEPRRVSNGVIIGAMLLSLCVLSIVKARYCATPFGKADDQLQEQMNSSIRMEPDESSPARYAR

SEQ ID NO: 89190 - DNA, 857 bp, Zea mays
  misc_feature: Ceres CLONE 1576756
  misc_feature (258)..(258): n is a, c, t, g, unknown, or other
  misc_feature (276)..(276): n is a, c, t, g, unknown, or other
  misc_feature (280)..(280): n is a, c, t, g, unknown, or other
  misc_feature (677)..(677): n is a, c, t, g, unknown, or other
  misc_feature (729)..(729): n is a, c, t, g, unknown, or other
  misc_feature (730)..(730): n is a, c, t, g, unknown, or other
  misc_feature (751)..(751): n is a, c, t, g, unknown, or other
  misc_feature (809)..(809): n is a, c, t, g, unknown, or other
  misc_feature (835)..(835): n is a, c, t, g, unknown, or other
ctcaccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttgngggaagctagcggcgggnccgngtcttggcccgaaaaaaaaaaatatgggccccccggggggggggggggggccccttttttcccccccccccctaaaaaaaaggggggaaaccggggggggggggggggggggaaaatttgggggggggaaaaaaaataaaaaggggggggggggggggggccccctcctccccccgggggaaaaccccccccctctgttttttttgtttgggaaaaaaaaaacccccccccccccccccaagagggggggggggggggggggccccccccccccccgggggggggggggggggggcccaaccacatactttttttttgggggggagaaaaaaaaaaaaaaagagggggggggcccccccccccagaggaaaagagaggggggttgtcttctcccgcnaaaaaaaaaaaaaaagaggagaggagggagagattttttttcgcctggcccnnaaaaaaaataggggtggtttnttcccccccccgcccccaggggggttgttttttaaaaaaaaaaaaaaaagagaggggngcgccgcgcgcccccccccccccaanagataatatattatgttttttt

SEQ ID NO: 89191 - DNA, 1053 bp, Zea mays
  misc_feature: Ceres CLONE 1576757
  misc_feature: Encodes the peptide sequence at SEQ ID NO. 89192
  misc_feature (63)..(63): n is a, c, t, g, unknown, or other
  misc_feature (66)..(66): n is a, c, t, g, unknown, or other
  misc_feature (68)..(68): n is a, c, t, g, unknown, or other
tttgtgactggacataaagctccttccccatttacaaacccaaccctgctctcctacaccccnccncntaaaagctggagctccccgcggtggcggccgctctagaactagtggatcccccgggctgcaggaattcgtctcacccctagaaaattttcctccgcgccaccacgagatgccctaaaaccctaccactctactaccatcacacctgcgcctccacagtccacactcaccgcgctcgccccctcacaacgaaacctagagagtcccgcgcgtgacatggcggacggcgcgggctcggcgtctggtctggtggagaagctcgcggagctttcaacgggcggcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggctgctgctgctgctagtggaaagcctcagaaggcatctgctgctgacgatgatgacatggatcccactcaatactacgagaataggctcaagaactcttgattcactcaaggcccgccacgtgtaaaaccccctaattccacataaagttttccagtttgggaatcttctggtaagggggaaatacatttggaggaaagtaaacaagaacctttgaaacacaaccgggggggaagaaagcctttaccagaaatgcccaaacagaaaaatggtttttaaggcttggggggaggggatttattgggaaaccaaagaagaaaactttcattccatatctaaaggctaaatttccgtttttaaaggaaatcctttactaggggaggggtgggcaaatgaaaagggtttccagagtggaatgggcctcgaaaggccaaggaaacaccccaaaaattttggaaaagaaacccctgaaaatttctcttaaaaagaccccacccccaaagggtgggaaaaccggggggggaaaatattggatggggcacaacaggtggggttattcctagagaaaaa

SEQ ID NO: 89192 - protein, 100 aa, Zea mays
  misc_feature: Ceres CLONE 1576757
  misc_feature: SWISSPROT Homolog: EC 6.1.1.6 Lysine--tRNA ligase
MADGAGSASGLVEKLAELSTGGAGQNPPPAGEGGEELQLSKNAKKREEKRKKLEEERRLKEEEKKNKAAAAASGKPQKASAADDDDMDPTQYYENRLKNS

SEQ ID NO: 89193 - DNA, 837 bp, Zea mays
  misc_feature: Ceres CLONE 1576759
  misc_feature: Translation starting site: 278
aagctggagctccccgcggtggcggccgctctagaactagtggatcccccgggctgcaggaattcgtctcacccctagaaaatgaacaacggctgcatggcgagcgcctgcgccacctccatccccctcgtctcggctccctgtgcttgctcgtccaataataccaccgtcgcctggttccggcgcccctcggagacgtgcaaggccatcatcccctgtggccgtggcctgtgccggccaaaatgatggcctcctttggctgcacctgctggacgtgatgctcgacggcatgtccagtggctcctcagggctcgcctgggacccgggcgtctcgtccggcgcggatgcggtgtgcacctgggccgataaggtgaacgagaagaccgtgcagtgcacggacccggtcgggcagcttccgtgcactctggtgtcacctacagacccagtagacttcaagcctgaaagaaaggtgacgctcatccggcagccggtgcatctcctgagactggagtacacatcgagaagtacaaggaggccgtcgcgtacatgaatgcgctaccggaagagaacacgctgagcttcgcgggacaagatgtcatccaacatggctagtgcgacgcctactactagtatgacccgacggcctatgacgcaccgttcgacttgcacttctcgtggagcttcacgccgtggcaccggagtgcatccactgctacgagcgggccctcgggtcactcatcggagactagcacttcgcgctgacggtatggatctgggatacgcagccggactgatgatgacgcttctgtcaaagacttcatgggtgacccggtgtat

SEQ ID NO: 89194 - DNA, 818 bp, Zea mays
  misc_feature: Ceres CLONE 1576760
  misc_feature (517)..(517): n is a, c, t, g, unknown, or other
ctcaccgcggtggcggccgctctagaactagtggatcccccgggctgcaggaattcgtctcacccctagaaaaatctctctctcgcggagctccctggcgagcgcccctgctccctctgtcctctcccctgcagctctctcttggtgcccagaatcttctgcttacatcccctggccgtgtgcccctgcgccggtcgagttccctgcgctcgccggcgctcctccctggctcgcccctccacgcgcctctggccctccctgccgtgcgcctgcccaggtccgcgccgcctctgctcctcgttcttctctgcgagacgtgtagctccttcctgcgcgcgccggccgccagttcgtcttcaacgtccagccatggagctcctgcgcgtcgcgacttcccttcccccgagttctccctgccatggcgcaccctccctgctcggcctttgctcctctggcgccatggaatctttgcgtgcgtgaagcttcctgctcgacggcgctcctccctgcgcccagncaaagccctttatcgggctcaaccgctcttcttttctccttccggacgggctcctctgcttccagcccgcccaaaaacttggcccgaacctctttccctggtttcaagggggggcttgggcacttttgcccctggctcggggttccctttttccggggcggtggcccaagcccgggggcttcccaccttaccccggaaaagcgggggccttctgtgtctgttggcccgggggcccccctgggggcgccctttggggtccctgggcccatattttcccaggggggggaccttccggggcgcg

SEQ ID NO: 89195 - DNA, 823 bp, Zea mays
  misc_feature: Ceres CLONE 1576762
  misc_feature: Encodes the peptide sequence at SEQ ID NO. 89196
  misc_feature (580)..(580): n is a, c, t, g, unknown, or other
ctggagctccccgcggtggcggccgctctagaactagtggatcccccgggctgcaggaattcgtctcacccctagaaaaacccgtgctcgtcatcaccacccacatctcagttcaccccggcgtcgtcctcttcccccggagctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccaggtccttgataccacggccatgcttggtgctgtcccagagcgctactcttggactggaggcgagattggcttgagcacctatttctcaatggccaggggaaatgccactgtccctgctatggagatgaccaagtggtttgatacaaactaccactttattgtccctgaacttggcccagccaccaagttcacatacgcttctcacanggctgtttctgagtaacgggaggcaaaagcgcttcggtatgatactgtcccagtggctgttgggaacagtgtcaatactgcttctcctctaagccctgccaaggggggtggaaaaaaatctttcccccctttctttcccttccttgggcaggaatttttccccttttaaaaaggagggttgttttctttaaactcaaaggcaaccggggggccttccggggaatttccgtttgaaaggaaccc

SEQ ID NO: 89196 - protein, 140 aa, Zea mays
  misc_feature: Ceres CLONE 1576762
  misc_feature (2)..(140): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (136)..(136): Xaa is any aa, unknown, or other
MASHIVGYPRMGPKRELKFALESFWDGKSSADDLEKVASDLRSSIWKQMSEAGIKYIPSNTFSYYDQVLDTTAMLGAVPERYSWTGGEIGLSTYFSMARGNATVPAMEMTKWFDTNYHFIVPELGPATKFTYASHXAVSE

SEQ ID NO: 89197 - DNA, 815 bp, Zea mays
  misc_feature: Ceres CLONE 1576763
  misc_feature: Encodes the peptide sequence at SEQ ID NO. 89198
  misc_feature (67)..(67): n is a, c, t, g, unknown, or other
  misc_feature (655)..(655): n is a, c, t, g, unknown, or other
  misc_feature (771)..(771): n is a, c, t, g, unknown, or other
gcgggtggcggccggctctagaactagtggatcccccggggctgcagggaaattcgtctcacccctnagaaaaaaaaaaaaaaaaaaaaaaaaaaaaaaaaaaaaaaccccgcgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaggttttgaaaactcctgtctcacttgatatgcttgggcgcatttttaatggttctggaaaacctattgacaatggccccccgatattgcccgaagcctacttggatatctctgagagttctattaaccccagtgagagaacctatccagaggagatgatccnaactgggatatccaccattgatgtcatgaaattccttggctccgggaaaaaaaaatcccactgttttctggctgctgggctccctcacaatggaattgctgcttcaaattttgtcntcagggtggggctttgtgaagacattggaaaaaaggaaaccctc

SEQ ID NO: 89198 - protein, 198 aa, Zea mays
  misc_feature: Ceres CLONE 1576763
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (145)..(145): Xaa is any aa, unknown, or other
  misc_feature (184)..(184): Xaa is any aa, unknown, or other
MGLVKEGIDMEEGTLEIGMEYRTVSGVAGPLVILDKVKGPKYQEIVNIRLGDGTNRRGQVLEVDGEKAVVQVFEGTSGIDNKYTTVQFTGEVLKTPVSLDMLGRIFNGSGKPIDNGPPILPEAYLDISESSINPSERTYPEEMIXTGISTIDVMKFLGSGKKKSHCFLAAGLPHNGIAASNFVXRVGLCEDIGKKETL

SEQ ID NO: 89199 - DNA, 825 bp, Zea mays
  misc_feature: Ceres CLONE 1576767
  misc_feature: Translation starting site: 188
  misc_feature: SWISSPROT Homolog: EC 1.4.1.2 Glutamate dehydrogenase
  misc_feature (818)..(818): n is a, c, t, g, unknown, or other
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatccgtgagatcgctgaagcttaccttggcagcacgatcaagaatgctgttgtcacggtccctgcctacttcaacaactcacagaggcaggccacgaaggatgctggggtgattgctggcctcaatgtgctgcgtatcatcaatgagccaaccgctgctgctattgcctatggtcttgacagaaggcaaccagcgtccgtgaagagaaatgtctcatctttgaccttggaggtggtacttncgatgtc

SEQ ID NO: 89200 - DNA, 851 bp, Zea mays
  misc_feature: Ceres CLONE 1576769
  misc_feature: Encodes the peptide sequence at SEQ ID NO. 89201
ctccccgcggtggcggccgctctagaactagtggatcccccgggctgcaggaattcgtctcacccctagaaaaaatccggccaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaaagacaacctcatctacaagctggtgtccgacgccgacatcccggagccgccgctgttcacggcatcgcacagctgggaagacaccccggagcagagcgtgcggctgaccaagccctacctgtcggcggcggagcgggtccaggaggccgtgggctgcttcccggcccggctggaggccgcgctggccgccgacgcgcgcggcatcaggcgctgggaccgtccgcgactttctccgacgcctacaggtccgggcaaggtgacggctggtccaggtggcgggcaaaggtcctccccggcggtgaagggaaaaacccgggggcccggggggggagcaaatatgggccttttttcttcagggggcgaaaccccgaacaaacttcatttatgggagggccacagaaatccccccccctctgggtaccccaaaagaggggggccccccttttcccacccctgggaacgggcttg

SEQ ID NO: 89201 - protein, 219 aa, Zea mays
  misc_feature: Ceres CLONE 1576769
MGLFSSPAKVYKPAADVDLGPGSDELYISPNVKAPRVAGLLVKIFVWILEMPIVGQIVLYILKKDNLIYKLVSDADIPEPPLFTASHSWEDTPEQSVRLTKPYLSAAERVQEAVGCFPARLEAALAADARGIRRWDRPRLSPTPTGPGKVTAGPGGGQRSSPAVKGKTRGPGGGANMGLFSSGGETPNKLHLWEGHRNPPPSGYPKRGGPPFSHPWERA

SEQ ID NO: 89202 - DNA, 798 bp, Zea mays
  misc_feature: Ceres CLONE 1576772
  misc_feature: Encodes the peptide sequence at SEQ ID NO. 89203
tccccgcggtggcggccgctctagaactagtggatcccccgggctgcaggaattcgtctcacccctagaaaaaatcggaatcctctctctcattcactcactctcttatccaaacgcccccgtgccccgtctgcgtcgcgtagggttttggcaacttgcacgtacgagcgtccatggacgacgggagcagcaacaaggtggttgaggacgtcgcggaggaggaccccggccgccgcggcggtccatggaggacggatgaggccgacgccaacgagaaggcgcctcgccccagcaggcgggtcgcttccctcgacgtcttccgcggcctcaccgtcgcgctgatgatactggtggacggcgccggcggcgagtggccggtcatcgggcacgcgccgtggaacggctgcaacctcgcggacttggtgatgcccttcttcctcttcatcgtcggcatggccgttcccctggccctcaagaggatcccggaccgtggccgagccgtgaggagagtggtcgtaaggacgctgaagctgctcttctggggcatcctgttgcaaggcggttactcccacgctccggacgaactggcgtatggagtcgacatgaggcacgtgaggtggggcggaaatccctcagaggaacgctcttgcgtaccggggggttgcgggtctagaagagggggacgaaagacggcgccaaggttcatcagggaccagtcccccaaggttccttcagggccgccttcctccccgtgtaattccagaaaaggattctcctcccaagggggattcggtcgca

SEQ ID NO: 89203 - protein, 208 aa, Zea mays
  misc_feature: Ceres CLONE 1576772
  misc_feature: SWISSPROT Homolog: EC 2.3.1.78 Heparan-alpha-glucosaminide N-acetyltransferase
MDDGSSNKVVEDVAEEDPGRRGGPWRTDEADANEKAPRPSRRVASLDVFRGLTVALMILVDGAGGEWPVIGHAPWNGCNLADLVMPFFLFIVGMAVPLALKRIPDRGRAVRRVVVRTLKLLFWGILLQGGYSHAPDELAYGVDMRHVRWGGNPSEERSCVPGGCGSRRGGRKTAPRFIRDQSPKVPSGPPSSPCNSRKGFSSQGGFGR

SEQ ID NO: 89204 - DNA, 785 bp, Zea mays
  misc_feature: Ceres CLONE 1576774
  misc_feature: Encodes the peptide sequence at SEQ ID NO. 89205
ctccccgcggtggcggccgctctagaactagtggatcccccgggctgcaggaattcgtctcacccctagaaaaagcgattccgcccccagctaatcttctcctcactctcccgctccactcctaaacccagaacccagcccgccgcaaccctagccgccgccgccgcgcgccgccggcaccacaccactgccgtcgccacccccatggccgcgccgtcagaggacgcgttgcggcgcgcgctcgcggctcgcaaggctgctgtggacgcgcaagccgaggccgtgcgcgcgctcaaggccggcggcggcgcgtccaaggccgacgtggacgctgcggtcgaggcgctgaaagcgcttaaggttgaggccggcgccgccgcgcacaggttgcaacaggcggtcggggcgggcgcgggtggcgccgcgagggaggagctgcggcaggcggtggtgaacacgctggagcggaagctgttctacataccttccttcaagatctaccgcggtgtcgcggggctctacgactacaggccgcccgggtgccgcgttaaggccaacgtgctttccttctggcgccagcactttgtcttggaagagaacatgttggaggttgactgcccctgtgtgacgcctagagttgtctgtgaggcatcacgccatgatgacgagtctactgacctcatggtctaagacgagaagaaggcacatgctaccgtgctgaccacctgttgaaagatttctgcaaggagaaagctgagaaagactttgaccttgcccaagagaag

SEQ ID NO: 89205 - protein, 161 aa, Zea mays
  misc_feature: Ceres CLONE 1576774
  misc_feature: SWISSPROT Homolog: EC 6.1.1.14 Glycine--tRNA ligase
MAAPSEDALRRALAARKAAVDAQAEAVRALKAGGGASKADVDAAVEALKALKVEAGAAAHRLQQAVGAGAGGAAREELRQAVVNTLERKLFYIPSFKIYRGVAGLYDYRPPGCRVKANVLSFWRQHFVLEENMLEVDCPCVTPRVVCEASRHDDESTDLMV

SEQ ID NO: 89206 - DNA, 2055 bp, Zea mays
  misc_feature: Ceres CLONE 1576777
  misc_feature: Encodes the peptide sequence at SEQ ID NO. 89207
aatcattccatgggattccccaaagcaactgtccgatcccatcgcgatggcaccgccgccgcaggagccaatccaccgccactgacgtaacccgatccatggaagcactaggatcttccgattacccccctcctcctcccaccttcctccgctccacccgccatatcctcgcctccctcgtcggcgcaaaccacacctccgcccgcttctgctcccgctagcaccaccaccagcaccggaccccttcccttcgcttcgcctccctcaccaggggtgacgggggcatggacccctcctccccgccgcggcgctgctccctcctcctccgcctgctcctcctcgccgtcgccgccctcgcgctccgtctcctctacggcgccttcctctccgtctccgccgggcccgcaggctggccgctctaccgccccgccgccaccgccacaaccaccacgcggaggaggacccacgtcgtccaggccgacgtcccgtcgccggaggtctggcgcacccgccactggcgcagggccgtcgactaccacgcggccatcctcgcgccgcacatcgccgccggcgccctcgcgcccgcgtcccgcgccgtctgcctgggcggcccgcaggaggcgctcgcgatgcgggagctcggcgtcgccaaagccgtcgccgtcggcaggaggcgtgcgccaccgctcgtcgtcgcggggggcgaccggagactgccgttcgactcgtcgtccgccgacttcgtcttcgcggggcgcgccctcgacgccgccaagcgcccggccgacctcgccgccgaggccgcgcggatcctcaagcccgacggccatctcgtcgtgctcacgtccagcgccgccgacgcctacagcctccgctcgatccaggcgctcctaccgacgctccgcctcgtccaatctcgcgagatcgacgcccaggacgacggcgactcctccacactcagggaacttgtcttccagaagaatccccatcctacgggcacgggcgcgggcaattcatcagtgaacaactgctcggttggggatcacaggcgccagctcctcgcgcacgccgagccactcatccaggaggagccgctcaagccgtggatcacgctaaagagaaacatcaagaacatcaagtacctcccggcgctggccgatatcagcttcaagcgccggtacctgtatgtcgacgttggcgcgcgcagctacggctccagtatcggcagctggttccgcaagcagtaccctaagcagaaccacaccttccaggtgttcgccatcgaagctgatccggcgttccactctgagtacgcggcaaagaagggtgtcacgttgcttccttacgcagcctgggtcaagaacgagacactcagattcgagatcaatggcgatcctggaaaggaggacgaggccaaggccaatggccgtggcatggggcgcatccgccctgctaccgggaagaagatgaacggcgaggtcaggagtgtccctgcgtttgactttgccgagtggttgaggcagaccgtgacggagcaggactacgtggtgatgaagatggatgtggaggggaccgagttcgatttgatcccgaggctgttcgacacgggcgcaatctgcttggtcgacgagcttttcctggagtgccattacaatcggtggcagaagtgctgccctggtgagcggtcgcccaagtatgagaacacctacgaggagtgcttggaccttttcagctcgctgcgggagagtggcgttctcgtgcatcagtggtggtaaaggcttcactggtaatttctccggtacagccgtttggaaatactatattgcagcgcagatagagtccaaagacaggtgacaaaaggttttgatttccacactgtattcatttttttatgctgtttagattgtgttggttaattttaaaggagtaaggtgaagtggagtgaacgaaatgtacttagggggtagttgcattcccagtaaaaaatcaatgtgccttgcaaacaattggaatgaatgaatgatacacacatgattcgaaaaaaaaaaaaaaaaa

SEQ ID NO: 89207 - protein, 496 aa, Zea mays
  misc_feature: Ceres CLONE 1576777
  misc_feature (105)..(185): Pfam Name: Methyltransf_11 Pfam Description: Methyltransferase domain
MDPSSPPRRCSLLLRLLLLAVAALALRLLYGAFLSVSAGPAGWPLYRPAATATTTTRRRTHVVQADVPSPEVWRTRHWRRAVDYHAAILAPHIAAGALAPASRAVCLGGPQEALAMRELGVAKAVAVGRRRAPPLVVAGGDRRLPFDSSSADFVFAGRALDAAKRPADLAAEAARILKPDGHLVVLTSSAADAYSLRSIQALLPTLRLVQSREIDAQDDGDSSTLRELVFQKNPHPTGTGAGNSSVNNCSVGDHRRQLLAHAEPLIQEEPLKPWITLKRNIKNIKYLPALADISFKRRYLYVDVGARSYGSSIGSWFRKQYPKQNHTFQVFAIEADPAFHSEYAAKKGVTLLPYAAWVKNETLRFEINGDPGKEDEAKANGRGMGRIRPATGKKMNGEVRSVPAFDFAEWLRQTVTEQDYVVMKMDVEGTEFDLIPRLFDTGAICLVDELFLECHYNRWQKCCPGERSPKYENTYEECLDLFSSLRESGVLVHQWW

SEQ ID NO: 89208 - DNA, 833 bp, Zea mays
  misc_feature: Ceres CLONE 1576780
  misc_feature: Encodes the peptide sequence at SEQ ID NO. 89209
  misc_feature (549)..(549): n is a, c, t, g, unknown, or other
ggcggccgctctagaactagtggatcccccgggctgcaggaattcgtctcacccctagaaaaaaagaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagtgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacagggtgacaatcttgactgacaagtttggacagccaaaaggttttgcttatgttgaatttctggaacaggaaggtgttcaggaagctcttaacnttgatgaatctgaattgcatggtcgccagattaaggtcgccccaaagaggactaatgttcctgggatggagcagcgtccaccacgtgggtataatccataccatggctaccccttatagatcatacgggggcaccgtatttcccccccatatgggtatggggagggctcctaggattccggccgccctatgcgctacagaccttactttctgagtacggggtagggggtaatgaagtttcattgcaaaacccagccccatggtcacctggtcagtccccgggaa

SEQ ID NO: 89209 - protein, 183 aa, Zea mays
  misc_feature: Ceres CLONE 1576780
  misc_feature (88)..(157): Pfam Name: RRM_1 Pfam Description: RNA recognition motif. (a.k.a. RRM, RBD, or RNP domain)
  misc_feature (145)..(145): Xaa is any aa, unknown, or other
MDEEEHEVYGQEIPEDGDMDGADVDMAASGDDAAKLQELDEMKCRLKEMEEEAAALRDMQAKVAKEMQGGDPSASTAEAKEQVDARSVYVGNVDYACTPEEVQQHFQACGTVNRVTILTDKFGQPKGFAYVEFLEQEGVQEALNXDESELHGRQIKVAPKRTNVPGMEQRPPRGYNPYHGYPL

SEQ ID NO: 89210 - DNA, 863 bp, Zea mays
  misc_feature: Ceres CLONE 1576781
  misc_feature: Encodes the peptide sequence at SEQ ID NO. 89211
ggagctccccgcggtggcggccgctctagaactagtggatcccccgggctgcaggaattcgtctcacccctagaaaaagacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcacaagactccgggtccggggacggcgccgtcgtggcgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcaggaccgcgcgcactgcgtcggcaccgaccaggacgcgctcgcgctggccgtccgcgacgccccgcgctaccccgcgcccgccatcaaggtcacgttccagcggccgagccccgcaacactgcaggcgtcgttcacggggcaccctgcgcagcccgcgtgggagggcccaaggcggccccgagccgtgcctggtgggcccttttacgagcaacggggctgggtgaaccgactgccggggccccggcgaagaaaaaaaggggcaaagtccgcttgcttcaaagcaaccaaacctttgttgcccgcccgttcctccgaggaaaggga

SEQ ID NO: 89211 - protein, 223 aa, Zea mays
  misc_feature: Ceres CLONE 1576781
  misc_feature (14)..(205): Pfam Name: DUF1223 Pfam Description: Protein of unknown function (DUF1223)
MAPRLLACFGRGVAAAPDDATGEGQLEAPPAGPVLVELFGSQGCGASPEADAVAARLAQDSGSGDGAVVALAFHVDYWDYRGWKDPFASSAWTVRQKAYVEALRLDTLFTPQVVLQDRAHCVGTDQDALALAVRDAPRYPAPAIKVTFQRPSPATLQASFTGHPAQPAWEGPRRPRAVPGGPFYEQRGWVNRLPGPRRRKKGAKSACFKATKPLLPARSSEER

SEQ ID NO: 89212 - DNA, 926 bp, Zea mays
  misc_feature: Ceres CLONE 1576783
  misc_feature: Encodes the peptide sequence at SEQ ID NO. 89213
  misc_feature (767)..(767): n is a, c, t, g, unknown, or other
  misc_feature (864)..(864): n is a, c, t, g, unknown, or other
  misc_feature (884)..(884): n is a, c, t, g, unknown, or other
  misc_feature (894)..(894): n is a, c, t, g, unknown, or other
  misc_feature (922)..(922): n is a, c, t, g, unknown, or other
ggagctccccgcggtggcggccgctctagaactagtggatcccccgggctgcaggaattcgtctcacccctagaaaaacgcgtcattctcctcccctccttccacccggcaaaaaccccgcgtcggccactctccggaggcgactagggtttcagcccctgggacacgccgccggtcgtggcacctccgccaccggatcccggtacccgagctacgccatcgccgccccgcccccggtcaccgccggtgcgcttccgccgacaccagacgcagctcgtccgccccgtcacgtgcacctctgcgtgggcgcgggattggatagggtttggggtttcggcggctggcgccaaatcccaccgctgctgctcgcgcaggaggtctcgagccctcggggttcccctactccgctccggctggagttctcgatgaaacttgttctacagtgttcttctgttgcatgactcagttgttttgagttatacttcataataacaatgcaaacacgaaaaaagggtgctgcaaaaaatgcagtggggtatcatgccaatcctaagacaagtaggccatccagaagggcaactcaatctacagttgctgaaaagaaagtatctgatctcatcacgtcttcttccaagaagcagagacctgttggtgtcacttccaagaagcattctaaaggaggaaggaagctgctagtttcatgtgatacaactgatgctggaaatgatgcacctcaggtaccccctagcgtcttccctgatctgcangcccagcatttctgatggtggttgcagatgatcgtcccaacgattcccatatctctccaacatacatcatcacaaaggaaagtgggtgtgaataccntatccaaaggctagaagaancaaacaccantgttcatgggtagtaaggaagctagccntaaa

SEQ ID NO: 89213 - protein, 95 aa, Zea mays
  misc_feature: Ceres CLONE 1576783
  misc_feature (91)..(91): Xaa is any aa, unknown, or other
MQTRKKGAAKNAVGYHANPKTSRPSRRATQSTVAEKKVSDLITSSSKKQRPVGVTSKKHSKGGRKLLVSCDTTDAGNDAPQVPPSVFPDLXAQHF

SEQ ID NO: 89214 - DNA, 844 bp, Zea mays
  misc_feature: Ceres CLONE 1576785
  misc_feature: Translation starting site: 109
ctctagaactagtggatcccccgggctgcaggaattcgtctcacccctagaaaaaaagaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagtgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacaggggtgacaatcttgactgacaagtttggacagccaaaaggttttgcttatgttgaattttctggaacaggaaggggttccggaagctcttaacctggaatgaatctgaaatgcatggtcgccagattaaggtcgcccccaaagaggactaatgttcctgggaaggaagaaacggcccccccggtgggtataatccataccctgggcttaccctttttaaatcatcccggggcaccgtatttttcccccccattgggttatggggaggggctcccaagaattccgccggccctaaggcgcttacagacctttacttttttggagttcgcgggggtgggggtaattgaagttctcaatgccaaaaaccccgccaccatggggtcacggggaaaaacc

SEQ ID NO: 89215 - DNA, 1029 bp, Zea mays
  misc_feature: Ceres CLONE 1576787
  misc_feature: Encodes the peptide sequence at SEQ ID NO. 89216
  misc_feature (16)..(16): n is a, c, t, g, unknown, or other
  misc_feature (71)..(71): n is a, c, t, g, unknown, or other
  misc_feature (72)..(72): n is a, c, t, g, unknown, or other
ataaaaattaattatntattcctcttcgtctgcgtccgcccgcccggcgccgcgggggtaaataaaatttnntgtaaaaaatggagctcaccgcggtggcggccgctctagaactagtggatcccccgggctgcaggaattcgtctcacccctagaaaaaaggcgagcagggacgactgcaggcctccccctctttctcggcttccactcacccgccaccactggaccacccccaacggcgagggagtgagagagatcggcagcagctcgggggcctggcagggcagctgcattgcgctgcggcgggcggcggccatggccgattcgtacggcgacggcaagggcccatcactcaagagccagagccagaaccagcagccgcgccctggcccccgcctcaagcccgccatcgagatggaggatctcatcaacctcctccacggatccgatccagtccgggtcgagctcacccgcctcgagaacgaactgcagttcaaggagaaggagctgggcgatgcgcaggcggagatcaaggctcttcgcttgtcggaccgcgcgcgcgagaagggccgtacaggatcttaccgaagaattggcaaaggtggatggggaagctgaaagctcacagaaagtctcctcccttgaaagccaaaaacctttgaaaagcaaagaaaaattcaaccgaaccaaaaaaaaaaaagccagccgcttttgcccggcaacaagttttgggcaggctttgaaggccaaccaactttaccgaaagggggtttcaattgccgggcccccaagaaaggggatggaatggaccattggcccctcccctaaattgaagggcccattcccctttggcccccccccttggagaaagcttgaagccttgaaaaactgggccccccgtcccaaggagaaatttggccaaaattttcccaaggaatgaaccaccccgggggccatatggggaatccgcctctttacaaaagtctctaaggggaaaagcagcctttttgtttttagaagactgaaaag

SEQ ID NO: 89216 - protein, 100 aa, Zea mays
  misc_feature: Ceres CLONE 1576787
MADSYGDGKGPSLKSQSQNQQPRPGPRLKPAIEMEDLINLLHGSDPVRVELTRLENELQFKEKELGDAQAEIKALRLSDRAREKGRTGSYRRIGKGGWGS

SEQ ID NO: 89217 - DNA, 828 bp, Zea mays
  misc_feature: Ceres CLONE 1576788
  misc_feature: Encodes the peptide sequence at SEQ ID NO. 89218
caccgcggtggcggccgctctagaactagtggatcccccgggctgcaggaattcgtctcacccctagaaaaactcttcgcttctaactccgctgggccaccagctttgagcgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtggagatgccccttaaggaagaatggggcggtgggaggatcccatgttggatccattttgacatctttctcatcatttttttgggaccctccttttggaggaaggggggggggaagcagcccgggggaagaagggcaacggagggggaaaaaaatttaatttcccccccccttaaaagtttccctcggggaaaaactttttacaaagggggcccctccaaagaaaacctctcttccttttcccccccatgggtcttcttgggttccaaaaggggccagggggaaagggggccctcaaaaattccggggggggcccccaaaggaggggggccccccggggttttgcccagggggcttccaggggatataaa

SEQ ID NO: 89218 - protein, 78 aa, Zea mays
  misc_feature: Ceres CLONE 1576788
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGGDAP

SEQ ID NO: 89219 - DNA, 966 bp, Zea mays
  misc_feature: Ceres CLONE 1576789
  misc_feature: Encodes the peptide sequence at SEQ ID NO. 89220
  misc_feature (82)..(82): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (98)..(98): n is a, c, t, g, unknown, or other
gcgacgacacacagaagcaagagcgcagcggaacgagaagcagagaaacccgacacaaaaaggaagaaggcaaataattttnttnnnnnggtgnnntnttcaaagctggactccccgcggtggcggccgctctagaatagtggatcccccgggctgcaggaattcgtctcacccctagaaaaagcggatggccgtcgttgacaccagctagtagcagccagcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaaaatggtggatggggcacacttatcttgggttcgagcaccatgtttggcacaatgctcaaactacatcaccttgaggccttctcggtgaggaagccatacggccaacaacagtggtgtttggcctaaagggcggtgcctcgggaatccctattcccatgggtggggtgcaaacccttggatttcctccagggggggggaaaaaaatttggggctttttcgggtaat

SEQ ID NO: 89220 - protein, 202 aa, Zea mays
  misc_feature: Ceres CLONE 1576789
  misc_feature: SWISSPROT Homolog: EC 5.4.99.8 Cycloartenol synthase
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNENGGWGTLILGSSTMFGTMLKLHHLEAFSVRKPYGQQQWCLA

SEQ ID NO: 89221 - DNA, 891 bp, Zea mays
  misc_feature: Ceres CLONE 1576792
  misc_feature: Translation starting site: 496
  misc_feature: Pfam Name: MoCF_biosynth Pfam Description: Probable molybdopterin binding domain
  misc_feature (626)..(626): n is a, c, t, g, unknown, or other
  misc_feature (782)..(782): n is a, c, t, g, unknown, or other
ctccccgcggtggcggccgctctagaactagtggatcccccgggctgcaggaattcgtctcacccctagtatcctgtggtcacggagtcgagggcgggcgacgacgccctcggagtggttgtcgtccccggcacggtcgcctacgtcaccaccggagggccggttcccgatggcgccgatgccgtcgtgcaggtggaggacaccgagcagctccctggcggagcggatgggtccaagagggttaggattcttgcgcgggcctcccaaagacaggacatccgcagtgtgggatgtgacatagagaaggattcgattgtgctcaagtctggtgagcatataggtcctgcagaaattgggctacttgcaacagtgggtgtaaccactgtcaaggtgtaccctcggccaacaatcgctgtattctccacaggggatgagctagtgcagccagccactgccaccctcagccgtggtcagattcgtgattccaatcgagccatgcttctagcttgtgctattcagcagaaatgcaaagtggttgacctaggtattgcagaggacactgaagaaagtctcaaggagcatatggatgcagctttgcgttctaatgctgatataatcattacttnctggtggtgtttccatgggcgacagagatcttgtcaaaccttgcctggcaaagatgggtaaaattcactttgagaagatccagatgataccaggatagccgttaacctttgctgagatcaccacacaagacacgccatagccatctaaaacagttncttgcatttggttttgcctggaaatcccagtgagctgtattgtttggctttaatcttttttgtggtccctgcaatcccgtcttctctctggctgggtcataccctcatc

SEQ ID NO: 89222 - DNA, 1031 bp, Zea mays
  misc_feature: Ceres CLONE 1576795
  misc_feature (14)..(14): n is a, c, t, g, unknown, or other
  misc_feature (83)..(83): n is a, c, t, g, unknown, or other
  misc_feature (102)..(102): n is a, c, t, g, unknown, or other
  misc_feature (120)..(120): n is a, c, t, g, unknown, or other
tttgttttctgttntgtatttaattactattctttctgaagggaagggatcgtgcaacagcacttatttttttgggtttttgnaaaaagctgggactccccncggtggcggccgctctanaactagtggatcccccgggctgcaggaattcgtctcacccctagaaaaaatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggccctggggaagggcccgccctggaactggcgcctgctgctgcgtgggggccctgcccggcgggggggcggtctacggggaaccaaactttcggcaagggccccaggtccccccgcaaaaaatttttttgcgggggaaaatttctgggaaaaccctgggaaaccttctcccccccccccttttccctttcggggaaaaaacccccgggggaatatcccaaagtcccccctccccgcccataaggggggccctcttattttttttttggggggaaaaatgtggggcacaccccccccgcgtggggggaaaaaaaaccccccttttttttccggggggcaaaaagggttttttaatggggggggccccccccaaaaaaaaaaaacccgcgaatatttttcttgggggggggtggggtaccccccccccccaacggggggtttcaaaaaaaagggtgtcttccttcttaaaaaagcgggcccccccccccccggggggcccctctcttaaaaaaaagggggggggtgaaaacaacccttttttttttgggggggcggagaacaaccacccggggggcccccccccgcggggggggaaattctccaaaaacc

SEQ ID NO: 89223 - DNA, 1021 bp, Zea mays
  misc_feature: Ceres CLONE 1576796
  misc_feature: Encodes the peptide sequence at SEQ ID NO. 89224
  misc_feature (771)..(771): n is a, c, t, g, unknown, or other
ctggagctccccgcggtggcggccgctctagaactagtggatcccccgggctgcaggaattcgtctcacccctagaaaaagagtcgtcgcccaatcggttgaatcggggagcagaggcatcgcccccacgcccaatcatccgcccccaaatccccagaagcacccacccctccgcgcgcgagatcccacgcgcgtccctcccacagtcccaccaccccccggggacgcggactccctcctccgtcctccccccccccccgcggtcccagcccagcggtggccctgcgacgaccgatggacgcggcggcgaagaagatgacgcggagcatctcgcggcagctctcgtcgggggcggcgcggctgtggcgccagctgtcgctggacccgcacaccccgcgccgcggcggcccgggcccggtcccagcggcgggggccgggcagacgcggttcgcgatcgccaggcagtcgtcgctcgacccgacgccgcgcggcggggcgggacgggtcgtcggcgcaccagcagctcgcggtgccggagaacctggacgccaccatggcgcttggtcttcgcccgcgtgccaaggggatgcccccggggtccaggaactgctcaggaacgggggtggacttcaaaagcatcaaaccccgaaggaagttacggcgctccacatccggcccttaaagggggaggggggaaggcctggccccctccttcttaaagtggaagggaaaaataaaccccccgaacccgtgtgtgtgtccccccccccnccaaaaccgcgaaaattttgggcgcttttggaagaataataaaaccccggaagacaagagggcaaaaaatccccaaaaacacaaaaaaaccccgggggggggggtaaaacacaaaaaaagtctgagagagaaaagcccaaccccttctaagggtgtgtttaaaaaaagaggaggaggccaccggggcgtctctctccgggaggaagggtggcgcccatattttttttttaaaaacacaaaacaaaaaccg

SEQ ID NO: 89224 - protein, 171 aa, Zea mays
  misc_feature: Ceres CLONE 1576796
MDAAAKKMTRSISRQLSSGAARLWRQLSLDPHTPRRGGPGPVPAAGAGQTRFAIARQSSLDPTPRGGAGRVVGAPAARGAGEPGRHHGAWSSPACQGDAPGVQELLRNGGGLQKHQTPKEVTALHIRPLKGEGGRPGPLLLKVEGKNKPPEPVCVSPPPPKPRKFWALLEE

SEQ ID NO: 89225 - DNA, 850 bp, Zea mays
  misc_feature: Ceres CLONE 1576798
  misc_feature: Encodes the peptide sequence at SEQ ID NO. 89226
agctccccgcggtggcggccgctctagaactagtggatcccccgggctgcaggaattcgtctcacccctagaaaaaaaaggaagaggaaagagggcgagtgcgacgggaggcgcaatgcggtggagatctcccgccgtgctgcggctgcagctgtggctgctcgccgtctccgcgtcgttggctgccctcggtgttctcgcggctgatcttagcaaagaaccatttactatccgtataagctgtggaagctttgacgatgtccggacggagcctacgaacacattgtggtacagagactttggttatactggaggcaggttcgctaatgccacccggccaagctttatcgttcctcctcttaaaacgcttcgatatttcccgctatctgatggccctgaaaattgctacaacatcaacaatgttcccaatggccactatcaagttagacttttctttgcgttactggacaaccctaatcttgacagtgagccgattttcgatgtttctgttgagggtactctgttcagctctttgcttctgggctggagcagcgacgatgagaagacatttgcagaaactttgggttttgtccaggactcaagcttatcagtttgcttcctagtacaggggcatgtggatccatcgatcttttctattgaagttctaccaatagatgaccatgcctataactttggtccacccgcgaaaaaagggaccgtggctagagcagtcaaaaggctgaaatgtggctcaaggaagcctgctttttgatgagaatctaatgggaattccctgggggtggggaacgaattctgggttagattgcaaacctttttcatcccgtttcgg

SEQ ID NO: 89226 - protein, 218 aa, Zea mays
  misc_feature: Ceres CLONE 1576798
MRWRSPAVLRLQLWLLAVSASLAALGVLAADLSKEPFTIRISCGSFDDVRTEPTNTLWYRDFGYTGGRFANATRPSFIVPPLKTLRYFPLSDGPENCYNINNVPNGHYQVRLFFALLDNPNLDSEPIFDVSVEGTLFSSLLLGWSSDDEKTFAETLGFVQDSSLSVCFLVQGHVDPSIFSIEVLPIDDHAYNFGPPAKKGTVARAVKRLKCGSRKPAF

SEQ ID NO: 89227 - DNA, 960 bp, Zea mays
  misc_feature: Ceres CLONE 1576800
  misc_feature: Encodes the peptide sequence at SEQ ID NO. 89228
  misc_feature (912)..(912): n is a, c, t, g, unknown, or other
ctggagctccccgcggtggcggccgctctagaactagtggatcccccgggctgcaggaattcgtctcacccctagaaaaaaaccgaacagggcctaaccattcccggctcccggcagagacggccgctcgcctccagaagagcaacccaagtcgccgagagcgactcccacacgacccacctaccccgccgccgccgccgccgcatccccctcgatcccgtctggcgatcgggggctcccagacacatcacagatacacaccacgctaagccaaatcgagcaacgcctatcatcatattataatttcccctcattcatctcacagtcccaggcctcccctccctcctccccgtcgccaaccaacctccaacccccagccgatcgcgtcggagatgctgggcctcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcagcagacccttctgttttcttgatgggagaagaggttggcgaataccaaggtgcatacaagatatccaagggtttgcttgacaagtatggcccggatagggttctcgatactccgatcactgaggcgggcttcactgggattgggtgttgggtgcccgcttaccatggtcttcgacctattgtagagttcatgacatttaacttttcgatgcagggcattgatcacataatttatttcggctgccaaggtcgaactaaaggtctgcgtggggcagatatctggttcttattggctttggggggtccaatgggggctgcccgctgggaattggtgaccaaacaatcccaagggctatggnagcttgggtatgaccaagtttccgcggattgtaaagtcccgacctccc

SEQ ID NO: 89228 - protein, 189 aa, Zea mays
  misc_feature: Ceres CLONE 1576800
  misc_feature (37)..(183): Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
  misc_feature (174)..(174): Xaa is any aa, unknown, or other
MLGLARRRLGSGCVLAQLAQALRPAAAPARTYSAAAKEITVREALNTALDEEMSADPSVFLMGEEVGEYQGAYKISKGLLDKYGPDRVLDTPITEAGFTGIGCWVPAYHGLRPIVEFMTFNFSMQGIDHIIYFGCQGRTKGLRGADIWFLLALGGPMGAARWELVTKQSQGLWXLGYDQVSADCKVPTS

SEQ ID NO: 89229 - DNA, 942 bp, Zea mays
  misc_feature: Ceres CLONE 1576804
  misc_feature (819)..(819): n is a, c, t, g, unknown, or other
tccccgcggtggcggccgctctagaactagtggatcccccgggctgcaggaattcgtctcacccctagaaaaaatattgatgatggtgttctacaaaataatggacactttgagaggcacggcagttcatggggcttccttcttctgctctatgtctttgtacaaatatctcgagttataattgttggtgttatatacccgatgttgcgtcactttgagcatgggttggacttgaaagaggccatgattcttgtatggtcagggctacgacgagcagatgctctgtcactatcattatctgttaaacgtaccatcaattgagttcaaccttaccttaaaccagaggttcgaacaacgtttgtgttcttcaatggtggcatagtgtttctgacccccaattttaatggctcaaccccacaattttggctacatatacccggcatggacaaattgttgcccaccaaatgttatagtatttgaaatataacaaggtaacgaaaatgctaaaaaaaagcattagcaggctttttgggtgaactaagggatgaacgaaggaacttgggacctgccgaactgggttttactgtgaaagaaatatactcacatgtttctgaaatgaaccctaaacttacgaagacagaaacattcccccatgatgattggtggaccaaagaatggaactgccttggcaatattattgaaaccttaaacaaatttccaaagtgcgggctttttgaaagagagaagcaagccccctttacatggcgaaatgtcttgaaaagaaagaccaattccctccaagtttccggcaaaatactncagaatgaaatccgagtggaagaaagcaaatggaacctttgtttcttgggagaaaacctatggtgaattgtgaaaaggtctaaaattcccatgttgcattttcccaaaattactataaggttc

SEQ ID NO: 89230 - DNA, 775 bp, Zea mays
  misc_feature: Ceres CLONE 1576806
  misc_feature: Encodes the peptide sequence at SEQ ID NO. 89231
ctccccgcggtggcggccgctctagaactagtggatcccccgggctgcaggaattcgtctcacccctagaaaaaatcccccctcccccggcgtgcgctccctcgtgtctctcttggcgacgactgggcaacggtcgcagctgtatgttcgagcccttcgccgacgacgttcaccaccaggaattttctcagctgtgccaatgatgggttgcttcactgttctcagatccaagaagaagaaaagccattttgataatcctcttgtcccaagcaagaaatcagttgatgcaagggaaagtacgtcctctagacttccggagccagaagttcatgtgccatctttgcaatcagctcctcctagttttaggaacagggtcaagatatccgagtcatcaaatgaagtttcaaacagaaacagcagggctcgcgtgctgtctgctccatcagcccttattgtggtcgatcagtttggctttccatattcggaataccgagatcaagatgactccagggataaggaaggtttgacaaaggggcatcgcttttcaaatcctttgccccttcctcttccttcacgcgaaggacattcttttaggaactctggtagttcaaagccagcaacgtaagcggccatttggagatgtctgggccctctccattgcctctaaagaaatgtgatgggacttagaatctctcctatgaagagatttcatctgcctggcaacgggttttctagtggatcagtgggtttcagaaaatacatggttcaacatcat

SEQ ID NO: 89231 - protein, 141 aa, Zea mays
  misc_feature: Ceres CLONE 1576806
MMGCFTVLRSKKKKSHFDNPLVPSKKSVDARESTSSRLPEPEVHVPSLQSAPPSFRNRVKISESSNEVSNRNSRARVLSAPSALIVVDQFGFPYSEYRDQDDSRDKEGLTKGHRFSNPLPLPLPSREGHSFRNSGSSKPAT

SEQ ID NO: 89232 - DNA, 779 bp, Zea mays
  misc_feature: Ceres CLONE 1576809
  misc_feature: Encodes the peptide sequence at SEQ ID NO. 89233
ggagctccccgcggtggcggccgctctagaactagtggatcccccgggctgcaggaattcgtctcacccctagaaaaaaaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcaacagctcgacgtacggacccttcggcaccgaggatggcacacctttctcactcccagttagcagtggcaagatcattggattccacgggcgggtctgggtcgtatctcaactcaatcggtttctacctgaagcaggtgcattttccaactccagtgaatccttctccagcttcacctctgagcctcccgagtccacaaagtagaaacagcgcctatggcctcaccggtggcgacgctagacctgacatggttctcgccgtgcgagacagaagagacagctat

SEQ ID NO: 89233 - protein, 175 aa, Zea mays
  misc_feature: Ceres CLONE 1576809
  misc_feature (22)..(151): Pfam Name: Jacalin Pfam Description: Jacalin-like lectin domain
MSIKSINGKSPIVVGPWGGTGGYPWDDGVYSTIRQIVIGHGAAIDSIRIEYDLKGRSVWSETHGGTDGGSETDKVKLDFPDEVLVSVSGHYGSVCGTPVIIRSLTFQSNSSTYGPFGTEDGTPFSLPVSSGKIIGFHGRVWVVSQLNRFLPEAGAFSNSSESFSSFTSEPPESTK

SEQ ID NO: 89234 - DNA, 913 bp, Zea mays
  misc_feature: Ceres CLONE 1576810
  misc_feature (51)..(51): n is a, c, t, g, unknown, or other
  misc_feature (79)..(79): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (112)..(112): n is a, c, t, g, unknown, or other
  misc_feature (118)..(118): n is a, c, t, g, unknown, or other
  misc_feature (119)..(119): n is a, c, t, g, unknown, or other
cggggggaggccgtgggtggtggcggcgctgcgcggggggtggggtgggtnccgtttttttcgtggggggttttctttntttttnnnnnccaaaactggaactccacccggntggcgnngccgctctaaaactagtggatccccctgggctgcaggaaattcgtctcacccctagaaaaagtaggactagcacgcacggtcaagtcctcacagcacgcagctacgcacaggaacactctcccttaaactacgacggaaaatagggctgggcgagcaatgtccgaccagcagtacccattgcctcatcctcgcagcaccaagcaagaagctctggacaatgaggacaaggagaaggcggcggctgcagcggcggaacaaagacaaacgaagcccgttccccaaaaacagcaactgcaacggccgaaagaaagggtgccgaaacccgacaccgcaaagcttgaacgccccccccttttcagggaagtaaaaaggccccccaaaaaccaggagggccccgggaaaagtttccccccccccaaaaaaagggcctcccccgggtgttccttttaatacccccaaagaaaaactttcctggttggggggtcccaagagcccccaaccggggagggggtttaaccctcggggggcccccccagggttttccccaaatttttttccccccccaccagggggaaaccctctgttaaaagaaccctttttttccccgggggggggttaaaaaacacccgggggggccttttttttcaaaaaaaactttgaaaaaaaaaagccccctcgggccccttttaggggccccccccctcccggggggggtaaaacaaaatgttctccccccccccaaaaaaaaaagaggcccccgttttaaacaaaaaaaattttttccccccccccc

SEQ ID NO: 89235 - DNA, 1133 bp, Zea mays
  misc_feature: Ceres CLONE 1576811
  misc_feature (54)..(54): n is a, c, t, g, unknown, or other
  misc_feature (57)..(57): n is a, c, t, g, unknown, or other
  misc_feature (65)..(65): n is a, c, t, g, unknown, or other
  misc_feature (1003)..(1003): n is a, c, t, g, unknown, or other
gaggcgcggacggtttcgccccccgggcggccatatatctcaaacccctggggnganaggtggtnggaacaaactggagctccccgcggtggcggccgctctagaacagtggatcccccgggctgcaggaattcgtctcacccctagaaaaacaccggtgccagcagagacgaccggccccggccccgccccggccgcagctgcccgaagccgccaaacaccgccagtcccccaccacatccgccagaaaccctctccctccctccctccctccctcatcggcgcgccgccaatggccgtgtggtgaagcgcacccgacggaagaagcaggcaccaacagccaagccccctttgcccttgcccttgcccttgccctcgccgccgccgtccgcggaaggttgagatcccaggattcagactggtgccattcgatttgatttggcgcggggtactttcctatggccgcctccatcgcgggctcgcccttctttccagggtcgccggcgcccggccgctcctaagaacgggccttggagagcgccccacagagccatggacggtcccgctgcgttttgcggcgaagcccggggagccctcgttcataatgccacgtgaaggggcggggcaaaaacggcggcggccccaccgcttggcccgtccccccaaaggggggaaacggggggggcaaaaattcctgccccgggggtccgggaattgttgggaaacaaaccgcaagaaacccggttacaaccgggttaaccctcttgccggttccggggtgggccccacaaagggaaatcttttttctaagcaaaaacacccaggtcctttcccccccgaaacaggtggagaagccaagggggctcccaccttaggggcgtgacaccaattccatcgaaacccgatttttatttctctttgtgtgtccgcccccccaaaaaaaaacccatatggggacccgaaaaagacccttggaaatttggggaaaaacccccactagcangtggcctcttggacacatgtcttcccactgtataacctcttttttgggcgtttttgcgcgcccgggaaatcataaccacggtaattggggccctcctgggtttccaaagcgcgaaactcttttgttccag

SEQ ID NO: 89236 - DNA, 777 bp, Zea mays
  misc_feature: Ceres CLONE 1576812
  misc_feature: Encodes the peptide sequence at SEQ ID NO. 89237
  misc_feature (665)..(665): n is a, c, t, g, unknown, or other
acccgcggtggcggccgctctagaactagtggatcccccgggctgcaggaattcgtctcacccctagaaaaagtttccacgccggaagtggaggcgagccagccagccggtcgctccccactgcttccacacccaccctcgctctctctctttcgctgtcacgcggggcccacccgccgtgcgtgcgccccatccaccaccgacccggcgccgtcgcctccatcgaagcgtttcgtttggtttgggtttcgaggagtggtgccgcggcggggtcgggactcgggagaggaggggccatggcggacaaggcggcgccgaggctgctgccggtggcggcagacagggacaaggacgaccgccgccgctgggcggcccgctgcggcttcgccgtcctcggcatcatgagtaccctcctcgtctacggcgtcctccaggagaagatcatgagggtcccgtatggagtggagaaggagttcttcagatactcgcttttccttgttttctgtaaccgcatcaccacatccatggtgtctgcaatggtgttactggcaagtaagaaatccttggaccctgtggctccgctacacaaatatggtggtgtctccatatcaaatatactgaccactacctgccagtatgaagccctcaagtatgtaagcttcccntgtcaaacgcttggcaaatgcgccaagatgatacctgtcatgatctggggcacaataaataatgagaaagaagatgttgcaaaggattacttctttggctgccgtgtgacta

SEQ ID NO: 89237 - protein, 160 aa, Zea mays
  misc_feature: Ceres CLONE 1576812
  misc_feature (28)..(160): Pfam Name: UAA Pfam Description: UAA transporter family
MADKAAPRLLPVAADRDKDDRRRWAARCGFAVLGIMSTLLVYGVLQEKIMRVPYGVEKEFFRYSLFLVFCNRITTSMVSAMVLLASKKSLDPVAPLHKYGGVSISNILTTTCQYEALKYVSFPCQTLGKCAKMIPVMIWGTINNEKEDVAKDYFFGCRVT

SEQ ID NO: 89238 - DNA, 1238 bp, Zea mays
  misc_feature: Ceres CLONE 1576814
  misc_feature: Encodes the peptide sequence at SEQ ID NO. 89239
  misc_feature (56)..(56): n is a, c, t, g, unknown, or other
  misc_feature (60)..(60): n is a, c, t, g, unknown, or other
  misc_feature (63)..(63): n is a, c, t, g, unknown, or other
  misc_feature (66)..(66): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (1238)..(1238): n is a, c, t, g, unknown, or other
aagaagcgtaatatatatccaaaaagaaccaacaccaaacaaaaataaaaacaccncccnatnaantnaaannaaaaaactgggactcaccgcggtggcggccgctctagaatagtggatcccccgggctgcaggaattcgtctcacccctagaaaaagacacaacggcgtccgggcagccgcctcctgtcgccagttcgccactctctggttgctgcacgacctctactctgcggggccaagatgtggaaaacggcacgatgaaatccggccagcggtccaagcacatgcagagcgtccggcaggaatctcggctgttccggcttctggacatcatcgccggcttcctcctcgtctccctgaccttcgtcgatatctccaagcccgattccatccttgtcagcctgaacagcaagctgccggtggaccaagtgcccacgtccatcctgatccacctcaaggttaactcgccccccccccggggcaattgagaactccccccaacgccctgagtggggaaaccctaaagtgggccaatggtcaaacccgaatccttaatccccagggggtttatgggggcaaggaaggaaaaaaagcccgggtacttggagccgggacccggaacctcaccccagggggggaattgaaccggaggcttatcaccccctcggaaaatagagaaccgggcaacccggggcccgttaaaatttccccccccccaggagagggggcgctttttggccctctccctcatagttgtattacacccgtcgaaagaggtcgcaacaaactaaacaacaggggagagggggaatactccgtgggtcgaccaccctgagggggcctcccgcggtgaagaaaacacacccacaagagatctggggaagagtttttcctccgcaagagccgtgttgttacctaagtacaacacacacatattttttcttgttggaactctccccagcgtggatccacccccccacaatatgtttcgcccatttctagaaggccacttttatcccctgtttttttatcacccacctcctcgggggtagagaaagacccccccttttgtgtggcggatatcttctcaaatgtgtgtgaaagaagagaaacacgcctgtcgcagaaagattcctggagtggtaggcttttgaatgatcttcccccccatatagtggggctaccatcaatgtgtagttgtgggcggctctggggtgatcttcttaaagaggagn

SEQ ID NO: 89239 - protein, 76 aa, Zea mays
  misc_feature: Ceres CLONE 1576814
MKSGQRSKHMQSVRQESRLFRLLDIIAGFLLVSLTFVDISKPDSILVSLNSKLPVDQVPTSILIHLKVNSPPPRGN

SEQ ID NO: 89240 - DNA, 805 bp, Zea mays
  misc_feature: Ceres CLONE 1576817
  misc_feature: Encodes the peptide sequence at SEQ ID NO. 89241
cgcggtggcggccgctctagaactagtggatcccccgggctgcaggaattcgtctcacccctagaaaaagtcggcggtcgtgaaccgaacaaacctttccccaaaatttcccctcccccgcaccgaacgaactctcgatccgatcccgatccctgcagggagccgcctcggctcaccgatccggccccggatccgctcgttgctcgacgggatctctcgatcgcggtctggacaagcatgctgcatcaggagaacagtgaggctttcgggaggcaccactctgagcagcttgcatgtgtcaacatgaggggagcagataatggtcatccgaatttccttcctgagaaatgccagattgcagtttgtcctgaagttcaccgaaggggtgaaaaagttggactatttgatgaagagctggtacatggtgttcatctaaccagtccttgtgttcagtcaccattggtgccaagtggtgtcaaagaaacacctatagtggatcataacaagagacctgcatccagtgacatactggacatagttgaatgcaaacggctgaagcaggaagatcaaatcgttactaaggaagacaaccatacatctgctgagggagattttcatgactaccccacatacacgacttgcgaaagaagctttgactcaccactatatgagagtgaggaaagtgaagatgaggggtgtagattcaccttctccatgttcacatgctcggcccctagttggaagagggtctatgggcctgccagcttttcatcaatcggttggcccctttttccttgaggaaacc

SEQ ID NO: 89241 - protein, 186 aa, Zea mays
  misc_feature: Ceres CLONE 1576817
MLHQENSEAFGRHHSEQLACVNMRGADNGHPNFLPEKCQIAVCPEVHRRGEKVGLFDEELVHGVHLTSPCVQSPLVPSGVKETPIVDHNKRPASSDILDIVECKRLKQEDQIVTKEDNHTSAEGDFHDYPTYTTCERSFDSPLYESEESEDEGCRFTFSMFTCSAPSWKRVYGPASFSSIGWPLFP

SEQ ID NO: 89242 - DNA, 862 bp, Zea mays
  misc_feature: Ceres CLONE 1576820
tcaccgcggtggcggccgctctagaactagtggatcccccgggctgcaggaattcgtctcacccctagaaaaatcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgagggatccattggagggcaagtctcccccccaccagccgcggtaattccagctccaatagcgtatatttaagttgttgcagttaactccgcctctgctcccgtgtcctcctcccctcgttccctcgtcccggacgcctccgccgcgccgatgcgccgcgcctcgccgccgcaagagctccccgccgccgggggcgagatccaagcggcgctggcccctgccaatgcctccaccgcgggcgccccgcggaggcggaggcttccttcacggcgctgctgggactccccacctcccaaggcatgggagctgcttcttcccccgaaagaacgcccccccggccctagccaaaagggcccggcgccaaacctttccccttctgacccccgcaacttcgttggaaacggcggcccccggccgccttttttcaccgttttggcgaccccccgttcccccggtacacccaatcctttcccacggttcccccggggccccggggcccc

SEQ ID NO: 89243 - DNA, 834 bp, Zea mays
  misc_feature: Ceres CLONE 1576822
  misc_feature: Encodes the peptide sequence at SEQ ID NO. 89244
tcaccgcggtggcggccgctctagaactagtggatcccccgggctgcaggaattcgtctcacccctagaaaaaactcctctaagccaccaaacacttgctatgcccgctcctccccgcgcactgctcagcacgccgtgcccgtgagaccatggacgcgagcgcggccaccgccaggcgcaagcgcaagcgccccgacgccgacatcaccggcgacgccgacgccgccgccgccgctgccgctgccgccgccccggtcgccgtcgacgaagcctcggacgccgaggtcgaggagttctacgccatcctgcggcgcatccgcgacgcctcccgccggctgtgcggcgccggcgcccggcccgccccgcgcgcgccggcgtggcggcccagcttctcctgggaggacttcgcgaccccggcccctggggcgccggcgcctgagaccccgacccccacgcagcaggagccggcgcaaccgcgggcccgacgagcctgtagccgtccgtccgcgctaccggcccgttcgccccgtggccggggctggacctgaacccggaacccggaaccggaagcgcccgggcaacccctcgctccggggcggggtccaggggtagcggaaacggtaagggggggggggcaaagggtaaccggggccgcctgggacccgggggccagccaaaggaaaaaacccctaaacgcgggggggccccctttgggggcgttggccccctataaaattctgagcctgtcctttttttgggaaagagtgtggccttggcgcccccccggggagaaatcccggggggaaaatttcactttggttacaccccccaaaa

SEQ ID NO: 89244 - protein, 132 aa, Zea mays
  misc_feature: Ceres CLONE 1576822
MDASAATARRKRKRPDADITGDADAAAAAAAAAAPVAVDEASDAEVEEFYAILRRIRDASRRLCGAGARPAPRAPAWRPSFSWEDFATPAPGAPAPETPTPTQQEPAQPRARRACSRPSALPARSPRGRGWT

SEQ ID NO: 89245 - DNA, 972 bp, Zea mays
  misc_feature: Ceres CLONE 1576825
  misc_feature: Encodes the peptide sequence at SEQ ID NO. 89246
  misc_feature (710)..(710): n is a, c, t, g, unknown, or other
  misc_feature (826)..(826): n is a, c, t, g, unknown, or other
  misc_feature (934)..(934): n is a, c, t, g, unknown, or other
ctccccgcggtggcggccgctctagaactagtggatcccccgggctgcaggaattcgtctcacccctagaaaaaccaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggaggaggacggcgtcgatgacctggacaacgagttcaactgggacggccatgactcgcagtctgtggccgagtccatgctctacggccacatgagctacggccgtggaggtgtaccctatggcgcgccacaagctttccagctnctcccctatgttccactccctcacctcgggcagatggtggatgacatcccaccggagcagcacgcgctggtgcctttcttcatggtgggtgggggggaagaggatacatccccttncctatgcggatccaagcttacctgtgcaacccagtctatgacccatccaaggatctgctgatattgggtatggaaggtgcctggaaggaccgatggaaattgggagcnaaacaaaaagtgccccacggatttttggttttgtgttt

SEQ ID NO: 89246 - protein, 207 aa, Zea mays
  misc_feature: Ceres CLONE 1576825
  misc_feature: SWISSPROT Homolog: EC 2.4.1.12 Cellulose synthase (UDP-forming)
  misc_feature (188)..(188): Xaa is any aa, unknown, or other
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGVPYGAPQAFQLLPYVPLPHLGQMVDDIPPEQHALVPFFMVGGGEEDTSPXLCGSKLTCATQSMTHPRIC

SEQ ID NO: 89247 - DNA, 972 bp, Zea mays
  misc_feature: Ceres CLONE 1576829
  misc_feature: Encodes the peptide sequence at SEQ ID NO. 89248
  misc_feature (361)..(361): n is a, c, t, g, unknown, or other
  misc_feature (972)..(972): n is a, c, t, g, unknown, or other
ctggagctccccgcggtggcggccgctctagaactagtggatcccccgggctgcaggaattcgtctcacccctagaaaaagcccacactccaccacccgcgccccgccgcccgccccgccgcctcctcctacttcgcctcggccgcctcggatccggaccgagctccggccatggcactcgccttcgacgagttctggcgccccttcatcatcctgcgggagcaggagaagaagacgcgcctgcgggggctcgacgcgcagaaggccaacatcggcgcgggcaaggccgtcgcgcggatcctccgcacctcgctcggccccaagggcgcggacaagatgctcctgtcccccgacggcgacntcatcatcacaaatgatggggcgaccatcctggagcacacccatgttgacaaccagatcgcaaagctgatggtggagctgtcccgtagtcaagactacgaaatcggggatggtaccaccggtgtggtagtcatggcaggggcgctccttgagcacgccgagaagcttttagaacgtggctttcaccccattaaggttgctgaaggctatgagatggcattcaaggtagcttttcgatcccctaggaacccatctgccgaaaagtttgagttcactgcaaacaacctttgacccccctgggtcagaaatggctgaacaactcctatcctcaaaaaattgtttaaccggtggcaagcgggggtttggccgtagattggctggtcacaacactccatgccgggtgccaaatttggaaaagaaggcatgttaactgggaattaattttaagcctaagggcacgttgggggggaaaccaagaggcaaccgcgcccggtcaatggaaatatggctcgcaaacgtttgacccctcgccatggcgcacaaaaaatggcggtgcgccaaattgtccaccgtgaatgccccttgtgagccccgaaggctaataccaagatn

SEQ ID NO: 89248 - protein, 159 aa, Zea mays
  misc_feature: Ceres CLONE 1576829
  misc_feature (64)..(64): Xaa is any aa, unknown, or other
MALAFDEFWRPFIILREQEKKTRLRGLDAQKANIGAGKAVARILRTSLGPKGADKMLLSPDGDXIITNDGATILEHTHVDNQIAKLMVELSRSQDYEIGDGTTGVVVMAGALLEHAEKLLERGFHPIKVAEGYEMAFKVAFRSPRNPSAEKFEFTANNL

SEQ ID NO: 89249 - DNA, 918 bp, Zea mays
  misc_feature: Ceres CLONE 1576833
  misc_feature: Encodes the peptide sequence at SEQ ID NO. 89250
ctggagctccccgcggtggcggccgctctagaactagtggatcccccgggctgcaggaattcgtctcacccctagaaaaaatcagaccgccagctgtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgataccatggcctgcagaagaaccctatctctgcacagcacccatcaagtatcagttcgccaactactctgcgaactacatctactggggcaagggcagcatccggctgcagctcatcatacagcgctgcgacttctccttcgccttcttccacggcagcctcagcaacccgatttagatcgcggtgtcggagactgtttccgtcaagaccccaaggctgccgtgttcccgtcgctggggcagggcactcccaccactatattacggtgacctgtaccaacggcttccccttcaatgaggagtacccggtccgggaagggggcaccctgggtccccagggtgggccccccagaaaaacggaggccggccccccggggaccttacctttaaaaccggggaacttttgggggaaaaccggccccccaacctcggggggaagggcccccgggttttctcccacacctcttctctgaggggact

SEQ ID NO: 89250 - protein, 154 aa, Zea mays
  misc_feature: Ceres CLONE 1576833
MAVALLAALVASAAMLAGTASASPAEGIQPLSKIAVHRATVEMQPSAYVRATPSLLGEQGEDTEWVTVKFGWKEPSEDDWIGVFSPSEFNSSATCPIPWPAEEPYLCTAPIKYQFANYSANYIYWGKGSIRLQLIIQRCDFSFAFFHGSLSNPI

SEQ ID NO: 89251 - DNA, 1313 bp, Zea mays
  misc_feature: Ceres CLONE 1576835
  misc_feature (17)..(17): n is a, c, t, g, unknown, or other
  misc_feature (68)..(68): n is a, c, t, g, unknown, or other
tatggtgagttcaacancaatacaacaagaagaaacaaacggacaacgcacggaatttttttatagtntgaggaaaaactggagctcaccgcggtggcggccgctctagactagtggatcccccgggctgcaggaatgcgtctcacccctagaaaaaaaaagaggttccactctgtctgttccctccttcctgctgttacaatgattgttactattagccagtctgagtaatacatgtgcatttggtattgtccttgtttagtagtaggtaatagttgttaaaatctaaaaccagccatccgtcttctgggaaaaagaggtatagtctccccgatcctaattctgcctatccggttgcattcttcgtgaatcactctccctacgtcctgttacgggactggttgttagaactgtagggacctttactcctatggtagagaatttgtttagagaagaccgatttctattgtactagatacttggaaaacccccctcttctcttttcctggtaaccaaagctgccctgagaactattaaaaatgtcgcacaactctttttgacgacggtagaatttcccaaaaccctgtttactttggccgtgatgccattaccccttgaagattcccctcaattgacattcctcttaactgttgagtagtcaagacgactctacgcaaaactgagggtcgctcgcttcccctctcgttgcctcagctgcgcgcccgcccgccaactgaatgttatattatccgaccgaactagatcttaacatcctttgtcgtcgagcgaccatatacgaagagagtcagacttggacacgcatcacactctctgttaacaatatggatctgtcgtgtttctgcttgcagagtctcgcaatgagcgcgattcctcaatagagggacaaatgtgctgagaattctctcgcggtgtgtatgcacgtagtgtccaggaagatgttcaatgtgtctttatagatcgcatagcactgggcgcgtctttccctggtgtttctgccttgtcatagagctatacaacgccctgttcgtcgtatggtcttcagcagatatagcgtagcacaccattgtctccaattcttctaccacacttgatctgagggtgtatgtgagatctacagatgtgtgcacactgcgcagttgccacaatcctatctaccggtcaccaccttctcatataatcgctctcagaatgttgtatattcctcgacaggaatgatttcttcgtaatctgcccagtgccaaccctagtgcaagtcgtgtgagaggcgctcacgaggctgctgcgtcagtgcg

SEQ ID NO: 89252 - DNA, 873 bp, Zea mays
  misc_feature: Ceres CLONE 1576837
  misc_feature: Encodes the peptide sequence at SEQ ID NO. 89253
ccccgcggtggcggccgctctagaactagtggatcccccgggctgcaggaattcgtctcacccctagaaaaaaggacccaaatgccccactcttattacctgctaattttgaatttcctaatcaggttgcagctgcttatataagctcactgaccccgcgttcgctttctccgactcccacctccggccaaatcggcctatagatcaaacgctgcactgtagggagcatgaagccagcggcgaatggaatccctagccgccacctccgtgttcgcgccctcccgcgtcgccgtcccggcggcgcgggccctggttagggcggggacggtggtaccaatcaggcggacgagcagccggagcggaaccagcggggtgaaatgctctgctgccgtgacgccgcaggggagcccactgattagcaggagcgctgcggcggcgaaggccgcggaggaggacaagaggcggttcttcgaggcggccgcgcgggggagcgggaaggggaacctggtgcccatgtgggagtgcatcgtgtcggacgatctcagccccgtgcacggctaccggtgcctcgtgcccgaggacaacgtcgacgccaccagcttcctctacgagtgcgtcgagcaggggccccagggaaccatcaaacgtcggccgcctacagcatggtggggaggccaccccacttgatggaggatggtgggcccaaagaccggcagggttaacggatcaatggggaccagggaggaaagagcccagagtggacacaaaaccaggtaagtgggaacgaccccgaaaggccaaaatccccggagggaaccaaatgcattggcgaggggaaagggcactcccccacaggcagggaatcgccaccag

SEQ ID NO: 89253 - protein, 147 aa, Zea mays
  misc_feature: Ceres CLONE 1576837
  misc_feature: SWISSPROT Homolog: EC 4.1.3.27 Anthranilate synthase
MESLAATSVFAPSRVAVPAARALVRAGTVVPIRRTSSRSGTSGVKCSAAVTPQGSPLISRSAAAAKAAEEDKRRFFEAAARGSGKGNLVPMWECIVSDDLSPVHGYRCLVPEDNVDATSFLYECVEQGPQGTIKRRPPTAWWGGHPT

SEQ ID NO: 89254 - DNA, 808 bp, Zea mays
  misc_feature: Ceres CLONE 1576839
  misc_feature (580)..(580): n is a, c, t, g, unknown, or other
  misc_feature (748)..(748): n is a, c, t, g, unknown, or other
ggagctccccgcggtggcggccgctctagaactagtggatcccccgggctgcaggaattcgtctcacccctagaaaaagtacacagaacggcaaacgggttcatgcacgaatctccagtcttgagtactcgaccttgctgccttcttcgtcggccggctcgcccgcgagcagcccggcgcggacatcctcgaggtcggcggcgtcggcgtcatcaggcgccgtggctggtccgtgggagctgtcagcgggcggcacgggcgccaagaactcggcccacgggcgcctcttggcctgctccacgacgtagtacagcgcgacgccggcgacgaccacggcggcgttgatgaggacggtcctggccgacgctaggcacatgacggtggcgatgagcacggcgggcggggcgcacatggcggcggcccccgcggtgccgacggggacccggtacggccgcgccaggtccgggttcttcacgcgcagcttcacgaaggcagcgaacacggccagcatgcccagccctgtagaaggaagttgaggaaactcgatgatctcctggaagctcatgaaggacaggatcancacccccggtcgccgagcacaggatgctgaaacgtcggcgtccgtacttgggacctgcgttcatcagcaccagttcacaaaaaaggattcaagtttttcgttcgatttggaagctgcctctgccacactgattcttttcaggtcggaaggccccagacttcaccttcnagccaagaatgggcagggattatgccccattctgggccaatcccaaaaacctgggaagga

SEQ ID NO: 89255 - DNA, 794 bp, Zea mays
  misc_feature: Ceres CLONE 1576840
  misc_feature: Translation starting site: 230
  misc_feature: Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: SWISSPROT Homolog: EC 3.2.1.65 Levanase
ggagctcaccgcggtggcggccgctctagaactagtggatcccccgggctgcaggaattcgtctcacccctagaaaaagcgtgagatctcaccttcgcctatctgttcatcgtggccccttggtcctcctccccgaccccgacgtgcgacatgaacgggaagcagagcccgcgcaatggccgaactgcgtaccacttccagcctgccaagaactggatgaacgacccaaatgggcctctgtaccacaagggcatgtaccacatgttcttccagtacacacccgcacggcccgacgttcggcaccgggaagctctcctggggccactccgtctccggcgacctggtgaactgggcgttcctgggcaccgcgctggacccgacgtcgccgttcgacgcccacagctgctggtcgggctccgccaccacgctggcggacggccgccccgccatcctctacaccgggcgcgacgcaagcggcgtgcaggtgcagaacgtggacgttccccaagaagccgtcggacccgctgctccgggagtggcgcaagccgcccggctgcaacccggtggtcccgcagccgggcgacttgacgggcaacaacttccgggaccccaccacaacgtggatggagcgctacgggctgtggcggttcgccgtcacggccgaggtcagcagctgagggctccacccctggtgtaccgcaagaagggacttctatgccctgggaactggggatcctgcaccgcctgcacttctttccccggaaagtgccccttcttggggaatgaccccgaac

SEQ ID NO: 89256 - DNA, 829 bp, Zea mays
  misc_feature: Ceres CLONE 1576845
  misc_feature: Encodes the peptide sequence at SEQ ID NO. 89257
  misc_feature (678)..(678): n is a, c, t, g, unknown, or other
  misc_feature (721)..(721): n is a, c, t, g, unknown, or other
tccccgcggtggcggccgctctagaactagtggatcccccgggctgcaggaattcgtctcacccctagaaaaattttttttctccccctcccaatcgacacaggattcactcgcccgcccagttgtttcttttagtgccgccccccattccgctctgatccgagcctttcgctcaaagcctccagcttttccaattgtttggtcacttcgggaaccaaggaataagttcttgcgctgtgcgcgatagagagcctgatccatccttccccatatcctattcctgtggcatttcgctgcgcttgcgccctgtgcgtggccactgcaggggaaggattttggcctggtttctctcttcttggggttccaagttttcgggcgagatcttcgcctcaaggcggttccttgcttttctggtattggcgcggctcttgttgctcccctacaagtccaaggaaagaatttggaggccgtggggggtcccttgcgaccggttctggtcgatttctcgggcagctccagctgaattcaagatgccgctgtgacccaccgctgcctggtttcttggaggaaggaaattttgcttcaattgggcgtcgttgagctaggcccctcctccagctcttgatccggtccatggggctctgccatggcaagccgacgcaaatcccggaagctgtnagcggagaggatccccacgtagcctccggcgcgggcgacggcngggaacggggcgacctcgccgtcggcagcggcgcccggcgcgatgcccagcacgccgaacagcccaagtttcccgttctactggcgagcccgctccccgcgtcagcta

SEQ ID NO: 89257 - protein, 65 aa, Zea mays
  misc_feature: Ceres CLONE 1576845
  misc_feature (30)..(30): Xaa is any aa, unknown, or other
MGLCHGKPTQIPEAVSGEDPHVASGAGDGXERGDLAVGSGARRDAQHAEQPKFPVLLASPLPASA

SEQ ID NO: 89258 - DNA, 825 bp, Zea mays
  misc_feature: Ceres CLONE 1576846
  misc_feature: Encodes the peptide sequence at SEQ ID NO. 89259
ggagctccccgcggtggcggccgctctagaactagtggatcccccgggctgcaggaattcgtctcacccctagaaaaaaccctccgccggcgacggctcacgcatcgctcggcgcccgccccgcgtccccgagacgacgaccggcagagcgcgccctcgcggcgctacccgacacctgcgacgaaacgccccgagtccactagtcgagtagtgcgtcgacgcaggggctcgggaacgcggtgtcgccatcgcggagccctagcgagatcgtcgggaaggtccgaaggcgagcacgtgtttgtgtaacctttctccccttcttccctttgccggccggcccttcagcggcgacaagtgcccaccaggcggtggtttacgttgagctgaggagtgaggaagatgtctggaaatccagtcggcgtcgacaacacttctaggaggaaatttgacaaggaagagtacttggagagagctcgacagagggagcagagggagaaggatgaagctcggaaaggcaaggaaaggggtcctcctgtgcaaagacagcctttgaaacacagggactatgaagttgatcttgattctcgtcttggcaagactcaggtggtgaccccgattgcaccattgaatcagcaggctggatactactgttctgtatgtgaatgtgttgtcaaagattcagccaactatttggatcatataaatggcaagaagcatcagagagcactgggcatgtctatgcgtgttgaaaaggcatcacttgaacagctatgcaggcgcttattggtcttccacgtggaggacatggcaccgcgacgatacaca

SEQ ID NO: 89259 - protein, 142 aa, Zea mays
  misc_feature: Ceres CLONE 1576846
MSGNPVGVDNTSRRKFDKEEYLERARQREQREKDEARKGKERGPPVQRQPLKHRDYEVDLDSRLGKTQVVTPIAPLNQQAGYYCSVCECVVKDSANYLDHINGKKHQRALGMSMRVEKASLEQLCRRLLVFHVEDMAPRRYT

SEQ ID NO: 89260 - DNA, 775 bp, Zea mays
  misc_feature: Ceres CLONE 1576847
  misc_feature: SWISSPROT Homolog: EC 1.2.1.13 Glyceraldehyde-3-phosphate dehydrogenase (NADP(+)) (phosphorylating)
  misc_feature: SWISSPROT Homolog: EC 1.2.1.59 Glyceraldehyde-3-phosphate dehydrogenase (NAD(P)(+)) (phosphorylating)
aagctggagctcaccgcggtggcggccgctctagaactagtggatcccccgggctgcaggaattcgtctcacccctagattaatgccgtcgggccacacatccgatccctccctggagcggcgctgcactttggccacatcacgcaactctcgactcctccctcatccactccagcacccggctacacagggagatgaccagcgtcttccacgcacggggtgcagaggctggactcctgcgacttctcctggcgcatgacggggtcgcgctccgtgagcgctgcacctcgggaggcgtccttctccgacatcctgggcgcgcagctcgtcgcctaggccaccggggagaacgccctgagggcgcccacggaggccaagctgatcgtggcgatcaaccgcttctgccgcatctgccggaacttcctcctgtgctggcactgcagcgaggactcgccaatcgacgtcgtcatcctgaacgacagcggaggcgctctgatcgcatccacctcctcatgtacgactccatgctcagcaccttaaaggccgacatcgagatcgtgagagactcgaccatcaacgtcgactgaaagcccatgacagtcgtgctcagcaaggacccgctaaagctcccctggtgagagctcaactttgacatcgtcatcgcaggcaccggagtatggcgatgacgggccccggggcctaaaaagtccatcaccggccgaaccggagaatagggaatggccaccggatccacctcaaagggggccgtacgtat

SEQ ID NO: 89261 - DNA, 824 bp, Zea mays
  misc_feature: Ceres CLONE 1576848
  misc_feature: Encodes the peptide sequence at SEQ ID NO. 89262
  misc_feature (824)..(824): n is a, c, t, g, unknown, or other
ctggagctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcggcggcgccgagtactaccggatcaccaacggactggacctagaggacaagctgcaccccggtgagcccttcgaccccctgggctggacagagaccccgacaggccggcatccctcaggtgaaggagatcan

SEQ ID NO: 89262 - protein, 228 aa, Zea mays
  misc_feature: Ceres CLONE 1576848
  misc_feature (83)..(217): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIAEVILVGGAEYYRITNGLDLEDKLHPGEPFDPLGWTETPTGRHPSGEGD

SEQ ID NO: 89263 - DNA, 798 bp, Zea mays
  misc_feature: Ceres CLONE 1576850
  misc_feature: Encodes the peptide sequence at SEQ ID NO. 89264
aaagctggagctcaccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggccttcaccgtccgcaacatcgcctccatggtcccaccctacgacaagatcaagtacgccggcacagggtccgccatcgagtacgccgt

SEQ ID NO: 89264 - protein, 137 aa, Zea mays
  misc_feature: Ceres CLONE 1576850
  misc_feature (79)..(137): Pfam Name: Pro_CA Pfam Description: Carbonic anhydrase
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYA

SEQ ID NO: 89265 - DNA, 840 bp, Zea mays
  misc_feature: Ceres CLONE 1576854
  misc_feature: Encodes the peptide sequence at SEQ ID NO. 89266
aaagctggagctccccgcggtggcggccgctctagaactagtggatcccccgggctgcaggaattcgtctcacccctagaaaaagaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaacctcatcaacaccgtctttgatgccaagcgtctcattggcaggaggtttagtgatgcctctgtccagagtgatattaagctgcggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctgggggtgattgctggcctcaatgtgctgcgtatcatcaatgagccaaccgctgctgctattgcctatggtcttgacaaggaggcaaccagcgtcggtgagaagaatgtcctcatctttgaccttggaggtgggtaccttcgatgtctccctcc

SEQ ID NO: 89266 - protein, 178 aa, Zea mays
  misc_feature: Ceres CLONE 1576854
  misc_feature (9)..(178): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNLINTVFDAKRLIGRRFSDASVQSDIKLRPFKVIPGPGEKPMIVVQHKGEEKQFAAEEISSMVLIKMREIAEAYLGSTIKNAVVTVPAYFNDSQRQATKDAGGDCWPQCAAYHQ

SEQ ID NO: 89267 - DNA, 950 bp, Zea mays
  misc_feature: Ceres CLONE 1576861
  misc_feature: Translation starting site: 374
  misc_feature: SWISSPROT Homolog: EC 2.7.7.14 Ethanolamine-phosphate cytidylyltransferase
  misc_feature (748)..(748): n is a, c, t, g, unknown, or other
  misc_feature (883)..(883): n is a, c, t, g, unknown, or other
ctggagctccccgcggtggcggccgctctagaactagtggatcccccgggctgcaggaattcgtctcacccctagaaaaaacaccacaccacgcgggagcggggcgggcaccagaagcagacggcgagcgagcgacacacctctcatctgcccgcccctctcctccgtccagcctctccccctctcctctcctctcctcccaaaacaagagcagcgagacgcgcgcgcgcgcgccacgagctggtggaacctcgccgcctcccgcggcagatctcgcgccgagccctggtttcgacgcgagatccgcgcccgccgtccgccgctcgccgcctccgtcccggagcattaccaggattatacttccaccttgaagatggcgatcggattactagcgtttgagagccaccaggggctctggaacagcggatactattcacagttgtttggaattggaggagttctcatcactcttaccattcttatgttatccacgggctactttgggggaattggtgccccatttgctccatatttctggccgtatctaggacaagttccaaagaagagggaacgcaaaaggcctgtgagagtgtacatggatggatgctttgatctcatgcactacggccatgcaaatgcattgcggcaggccaaattgctgggcgatcagcttgtagttggagtggttagtggatgaaggagattgtggcaaacaaaggtccacctgtcctttctatggaagagaggntgactctttgtagtggtctcaagtgggtcgatgaggtcgtttcccatgcaccctatgagataacagaagaaatcatgaatactctccttcaacagtacagcattggattacattatcatgaagatgatccttgtnctctacctgatggcactgatgcatatgccctacgaaaaaagtcgggcgttacaagcatcaaggggaa

SEQ ID NO: 89268 - DNA, 892 bp, Zea mays
  misc_feature: Ceres CLONE 1576864
  misc_feature: Encodes the peptide sequence at SEQ ID NO. 89269
ggagctccccgcggtggcggccgctctagaactagtggatcccccgggctgcaggaattcgtctcacccctagaaaaagcgagacccagcgccagacagagccagcaatggctgctgctcctcctcatcctatatagcggggcccgtgccgagcgctcgatccagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacacccctgcggcggcggcggagacggcccccatggaggagaaggagcgcagggcgctgtacgccgccatcgagagcttcgtcggcaaggggtggaacggctccgggctctacccagacacctgcggctggtctcccatccagggggtgtcatgtgatctcttccatggcctgtggtacccaacagtggatgagcattggcccgtcccttgacaactcgctgcagtgggggccccgacgccaagttcagcgccccacctggttcgacttgagggcgcctccgggacgctgtctttttctaccggctgctttcccggggagaaaacccccacgggccaatcccgaaccggcaaactggggaaaaaacttggcgggggaacccctggaaaaaccctgggaatttcctcacccaaaccccggggcctggaaagggggggccaattccccggcggttcccctttcggccccccctgggggccaagcccgggaagattccccttgggtggccccgcggggagaaaaacaaccctttgtcgggggggccc

SEQ ID NO: 89269 - protein, 106 aa, Zea mays
  misc_feature: Ceres CLONE 1576864
MRRARGRRGLLLLLGVALSAAALLRGCAGQQGEDGSDTPAAAAETAPMEEKERRALYAAIESFVGKGWNGSGLYPDTCGWSPIQGVSCDLFHGLWYPTVDEHWPVP

SEQ ID NO: 89270 - DNA, 1082 bp, Zea mays
  misc_feature: Ceres CLONE 1576870
  misc_feature (48)..(48): n is a, c, t, g, unknown, or other
  misc_feature (57)..(57): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (95)..(95): n is a, c, t, g, unknown, or other
  misc_feature (1082)..(1082): n is a, c, t, g, unknown, or other
aacacggagagagaggaggaagatataaaagttataatataaataaancggggcctnccacnnnncnnnnnnnnnngcaaagctggtactccccncggtggcggccgctctagaactagtggatcccccgggctgcaggaattcgtctcacccctagaaaaaatggattccagcccacacgagaagaagagagccgagcagctgtatccgaatccttcgccaagcctagcctagcctgtttcgtctcctcccaccgcggatccaacctcatcccgcccaccctcctgcgctgagagagccttatctccatcatgccgcagtctccgcgcatgtgggggcaggtgacgttgatcccgcatctcccctccatctcctgaaccgccacggaggtggcggcggctgccgcatggaagcctctgacacctgatgaggaggctgtccggttcagcacccactccgtagacgtccgggcctagacgcccaccaaacagatgggcaatgaatagcattttgggtctcaaagaggacggctaagatcgaacccatacgggacagtatggtgagtgcttgaaatgggccagctgtattgaaatcccaaaggggtggccatttccccaattaacccccaattgaagggggtgcccttctggggggcccccctaattttccctggaaaaaaaacacaccgcgtctctccctggcggggaactataggcgtgggaggccgtggtgaagtcaattcgggtggtcccgaaaccaggggaatttgggtggcaccccaaggcgccttatggttgccctcttcccacccctaaagacagcgctaacaccccgcccttgtgaaacactggggggggatatacaaaaagccgccccttttcccgggggcaacaggggggaccccacccaaacacgggccgaaagttttcttttgccctttggcagaaggggaaaaaagcgggtcaaaaagggggtgccctttccagatatgccctttggaacaacgccccccacaaagcctcaaaaaaataaaccatgagaaggccttcactcccccccaaagtaaaggggccaccggcccn

SEQ ID NO: 89271 - DNA, 935 bp, Zea mays
  misc_feature: Ceres CLONE 1576871
  misc_feature: Encodes the peptide sequence at SEQ ID NO. 89272
gagctccccgcggtggcggccgctctagaactagtggatcccccgggctgcaggaattcgtctcacccctagaaaaaatcgccccgaccaaagcttccccagacggcaggagacagcagcaggccggacgccggactcctcctccctcccccgtacgcatccactgagatccttcctgtgcgaaggaaatctccagttcttcggccccggccaggttttcaagtgttgcttgccccgccggagttttcctctaacccgcaagtccaattggctaagaagttgatgggatcggggggacactggaaggctgtgtgagatcgcgaaggggaccgtgaattccttgcagggctgcggcgattcggctgcgctgctgtatgaactgtttcgtgaacctgggactcaactcgaactcgaaccactacgtcgcctgcctcctcatcttcctgctgcatttctccccccagttgttaaatccatccaattctaattcaaatagtaattgtgaaggagttcaacagagctgcacagatggcgaacaacagctcatatggtgaaaatgctaggagaaagccacacacaccatctgctattgttattggtggtgggtttgctggtcttgctgctgctgatgctctcacaaatgcatccttccaggttattctactggaatcccgtgataggattggtggcagagttcacactgactactcttttgggtttccggtcgatttgggagcatcttggcttcatggggcctgacgaagaaaatcccttgcaccaattaattggaaggcttgggactccactgtaccgcacaagagggggattgattctgggcttgtttgatcaggaatccagagaagttatgcactctattgacactaacggaccccccaggacctccaggagttggtcgaaaaaccttggggaagggg

SEQ ID NO: 89272 - protein, 76 aa, Zea mays
  misc_feature: Ceres CLONE 1576871
  misc_feature (41)..(74): SWISSPROT Homolog: EC 1.4.3.4 Amine oxidase (flavin-containing)
  misc_feature (45)..(75): SWISSPROT Homolog: EC 1.5.3.11 Polyamine oxidase
MANNSSYGENARRKPHTPSAIVIGGGFAGLAAADALTNASFQVILLESRDRIGGRVHTDYSFGFPVDLGASWLHGA

SEQ ID NO: 89273 - DNA, 915 bp, Zea mays
  misc_feature: Ceres CLONE 1576873
  misc_feature: Encodes the peptide sequence at SEQ ID NO. 89274
tccccgcggtggcggccgctctagaactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcacaaacgtttgcttggtctcctgcttcccttgagtcttgcccaccatagttttctctcatctctttcggtgacttgaccaacatctctttttgggcctggcagtctcgcaatacttcccttttccaagacttgttctaagaggttggaattgcccctggttctttgccgggccgctgcagcttggttggaaagtctttaacttggctgacattcccgtggctcacacctttttgcaaaagctggcctcttcttttctggcccagggggtttggtgaataattcggccacctacaaacttttatctttgcctggggacaaacataaaaatattcactctcttacttggggcaaaacaaggggggatccccccttgtaaagcaatagacagcatttgttagcctcaaaggacatttttctcggtttgtttgctagaaaggccaattaaaaagtgcctttgtggtcgagatgggaccaaaaataagacctatccccccggggaattccctgtaccacgtcgg

SEQ ID NO: 89274 - protein, 29 aa, Zea mays
  misc_feature: Ceres CLONE 1576873
MSAEVAGGHPYFLSCYFWFIYCIKFRDFT

SEQ ID NO: 89275 - DNA, 849 bp, Zea mays
  misc_feature: Ceres CLONE 1576876
  misc_feature: Encodes the peptide sequence at SEQ ID NO. 89276
ctggagctccccgcggtggcggccgctctagaactagtggatcccccgggctgcaggaattcgtctcacccctagaaaaacccacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacacttttgaaagctgctctcttctgctctgcgttgttgatttctgcactcaagcttctcttgcctgtgcactcaagcttctctcttcctgggcaactagtgatctccttgaagcatttcagcttttacctagagatctttctgttgttgctgaaggcagagaggctttagggtgatggcgcaaactagcctgcctcctggttttcgtttccacccacctgatgtgagctcgtttcta

SEQ ID NO: 89276 - protein, 29 aa, Zea mays
  misc_feature: Ceres CLONE 1576876
MSAEVAGGHPYFLSCYFWFIYCIKFRDFT

SEQ ID NO: 89277 - DNA, 914 bp, Zea mays
  misc_feature: Ceres CLONE 1576878
  misc_feature (135)..(135): n is a, c, t, g, unknown, or other
  misc_feature (140)..(140): n is a, c, t, g, unknown, or other
  misc_feature (160)..(160): n is a, c, t, g, unknown, or other
  misc_feature (170)..(170): n is a, c, t, g, unknown, or other
  misc_feature (225)..(225): n is a, c, t, g, unknown, or other
  misc_feature (231)..(231): n is a, c, t, g, unknown, or other
  misc_feature (249)..(249): n is a, c, t, g, unknown, or other
  misc_feature (251)..(251): n is a, c, t, g, unknown, or other
  misc_feature (253)..(253): n is a, c, t, g, unknown, or other
  misc_feature (264)..(264): n is a, c, t, g, unknown, or other
  misc_feature (283)..(283): n is a, c, t, g, unknown, or other
  misc_feature (292)..(292): n is a, c, t, g, unknown, or other
  misc_feature (299)..(299): n is a, c, t, g, unknown, or other
  misc_feature (301)..(301): n is a, c, t, g, unknown, or other
  misc_feature (302)..(302): n is a, c, t, g, unknown, or other
  misc_feature (305)..(305): n is a, c, t, g, unknown, or other
  misc_feature (308)..(308): n is a, c, t, g, unknown, or other
  misc_feature (318)..(318): n is a, c, t, g, unknown, or other
  misc_feature (341)..(341): n is a, c, t, g, unknown, or other
  misc_feature (343)..(343): n is a, c, t, g, unknown, or other
  misc_feature (344)..(344): n is a, c, t, g, unknown, or other
  misc_feature (347)..(347): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (364)..(364): n is a, c, t, g, unknown, or other
  misc_feature (365)..(365): n is a, c, t, g, unknown, or other
  misc_feature (376)..(376): n is a, c, t, g, unknown, or other
  misc_feature (405)..(405): n is a, c, t, g, unknown, or other
  misc_feature (408)..(408): n is a, c, t, g, unknown, or other
  misc_feature (412)..(412): n is a, c, t, g, unknown, or other
  misc_feature (417)..(417): n is a, c, t, g, unknown, or other
  misc_feature (431)..(431): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (473)..(473): n is a, c, t, g, unknown, or other
  misc_feature (474)..(474): n is a, c, t, g, unknown, or other
  misc_feature (526)..(526): n is a, c, t, g, unknown, or other
  misc_feature (590)..(590): n is a, c, t, g, unknown, or other
  misc_feature (821)..(821): n is a, c, t, g, unknown, or other
  misc_feature (891)..(891): n is a, c, t, g, unknown, or other
tacccgcggtggcggccgctctagaactagtggatcccccgggctgcaggaattcgtctcacccctagaaaaagctagaaagcaatcgcccgcggtattatccatccaccacgctgcatctgcttctcagcgccncctcnccttcctcttccacccctcnccgtccgtcntcctcagcgcttgtacgcttgcctcaaaacccctggcgccgtgctaaaaccctanccctcnaattccttcccctgcccncncngaacaaacaancctgaacccttcctcctcntccatggcntcctcangnnccnccnctaacctctnggtactgcttggtctcggcatcncnnccnttctcctggcnnnctcnnctactgaggcnccctgctctccccgatcaccgccccttcntcncccncctcnatctcctccctccnccccatcctcctcctccccnnngccccccaccctcttcaccnnactctccttctccttccctaaccccttttcatttccactctttttttaccanttttcccccgtcttgaaaggggggggggggggggggcacataaattccctaccctctttccttnttttttcccctcctttttttattcttcgttgcttttgggggggggggggggcaaactctttttttcccttaaaatttcccttacccttatcccaatttatttctaattacaatatctcgggggggggggggacccaatcccttcccccccccccctatcctccttccccccttctccattttccccttttctattcctcctttttgcccttttccccttcttccaaatttnttttctttttttccccctcccccttttttcacccccctcattttttatctctttaccctcttcccactcnttcccctgctcaggggggggggg

SEQ ID NO: 89278 - DNA, 882 bp, Zea mays
  misc_feature: Ceres CLONE 1576880
  misc_feature: Encodes the peptide sequence at SEQ ID NO. 89279
  misc_feature (741)..(741): n is a, c, t, g, unknown, or other
  misc_feature (751)..(751): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
ggatctcaccgcggtggcggccgctctagaactagtggatcccccgggctgcaggaattcgtctcacccctagaaaaagcccaaaccgcaccaacggccaacgcacaaaaaaccattctcagcctcctctcctactcgagcagctagcccagtcaatcattctgcttggattggatccaccttgtctctgaaaatagcttcgagaccttagcgcccaagaaacggtgaccgaccgtccctgcgctagtagcaacagcaacaatggcggcggagcgcctactcgacgggtacgagcaggacggcgaccagcccggcgacaaccgcatgcgccgcctgccgtccttgtcgacggtgattcgggaggcgatgatgcagaaggagatgcagaacctgctcaggtgtctggagcctctcatccgccgagtggtgcaagaggaggtcgaggcagggctcaggctcatgcagagcctgcgctacatctagagggcgccggcggagacccggcttgcggagcgggcggcgtggaagctggcgttccggacgccgccgcagctgccgatcttcacgggcagcaaaatcgagggcgaggccgggaggccgctggaggtggtcctcgtggacgcaagcaccggctcgcccgccgcgcccccggtcccgcgggcgctgcgcgtggagctgatcccggtgttctgcgacttcccgccggactggcgcgaggactgggccgcgtactagttgganaggagcgtcntgagggagcgcgagggcaggcgcccgctcctgtacggcgacgtctgcctcacgctgagggacgggcgcgccacggtgggcgagctccggtcacggacaatcgtgnnnnnnnnnnnnnnnnnnnnnnnnnnt

SEQ ID NO: 89279 - protein, 73 aa, Zea mays
  misc_feature: Ceres CLONE 1576880
MAAERLLDGYEQDGDQPGDNRMRRLPSLSTVIREAMMQKEMQNLLRCLEPLIRRVVQEEVEAGLRLMQSLRYI

SEQ ID NO: 89280 - DNA, 894 bp, Zea mays
  misc_feature: Ceres CLONE 1576881
  misc_feature: Encodes the peptide sequence at SEQ ID NO. 89281
  misc_feature (356)..(356): n is a, c, t, g, unknown, or other
  misc_feature (417)..(417): n is a, c, t, g, unknown, or other
  misc_feature (548)..(548): n is a, c, t, g, unknown, or other
  misc_feature (601)..(601): n is a, c, t, g, unknown, or other
  misc_feature (727)..(727): n is a, c, t, g, unknown, or other
  misc_feature (781)..(781): n is a, c, t, g, unknown, or other
  misc_feature (782)..(782): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
ggagctccccgcggtggcggccgctctagaactagtggatcccccgggctgcaggaattcgtctcacccctagaaaaaaggtcgagggctcctgtatctttaccgtctccaatcgatcccatctcctcgccatcgccgccgccatggcgttcctagcgcgggctctccgccagtccaattcgcgtctgtcgtcgtgcccctccgtcgccgcgtcctgccgctggatctcccggaccgccgccgcgggatcgccggaggccggcgcggcggtggcgccggctgacccggagttgcctccaccccgggagcctgttggcggcgcccgcgtggagcttcctccccacccggaggacacnctccaagtggtcgtggatgggcacgcggtgcggatcccccccaggggtcaccgtgctacangcctgcgaagatctcccggcgtcaaaatcccgcgtttctgctatacatagccgactctccatcgctgggaactgcccgtatgtgcctccgttgaaggtcgagaagtcgcctaagccccgttggcatccttntgcccatgaccccccccctcccggggatgaaaaaaaagaaaaaaaacccccantggccaaaaaagccaaaggaagagagggggcactggaaaggtacttcttgatgatgacatcccacccgggagtgcccattctgtgataaagggatagggggggaggggggcaccccccgagacccnacacccttgggatttggggggtaaaccgcggtccggttacttgaaaaaaaaacnnaaaaccccattttgccaaagaaaaaaaatttgtggaaaaaaaaaaggggccccccctctgtaaaaaaaaaagaaaaccccccctgcccccaaaggnnnataaaaaggtgttg

SEQ ID NO: 89281 - protein, 107 aa, Zea mays
  misc_feature: Ceres CLONE 1576881
  misc_feature (92)..(92): Xaa is any aa, unknown, or other
MAFLARALRQSNSRLSSCPSVAASCRWISRTAAAGSPEAGAAVAPADPELPPPREPVGGARVELPPHPEDTLQVVVDGHAVRIPPRGHRATXLRRSPGVKIPRFCYT

SEQ ID NO: 89282 - DNA, 807 bp, Zea mays
  misc_feature: Ceres CLONE 1576882
  misc_feature: Encodes the peptide sequence at SEQ ID NO. 89283
cgcggtggcggccgctctagaactagtggatcccccgggctgcaggaattcgtctcacccctagaaaaaatgttctgtttcactcctcctgctgtcttcggatctcacgaagccaggctagggttatgcctccttcccgctggcggcctctcaccgagcgagactgagctgtgcttagtaagccatgtctctgcgccccagcgagcgggtcgaggtgcggcggaaccgctactaggtggcggttgactccgacgacgggcggccgccgcgcgaggacaatatggtggagatccgcaagagcagccgcgaggagaggcttctcaagaggcgccgcgaggggctccaggcccaggtccctgacccctccctcgggggtcgagaagaatcttgaaagcctcccacctatggtcagtggggtttattcggatgactataaccttcagcttgaggccaccacacagcttcgcaagttgctatctatagagaggagccctcccagttgagaacttatcatatcacgtggactgccgagatttgtgcagctgctcacaagagaggatttgccccagctgcagttcgaagcagcatgggctctcacaaatattgcttctggcacttcacaaaatacaaatgttgctattgatcatagcgctgttcctatatctgtgaagcctcttgggtctggtactgatgatgttcgtgagcaggctgtgtgggcttctggcaatgctgctggcggattctcgaagtgtccggaacttggtctcgccgatgctgcattgatacctattgttagccgagttgaat

SEQ ID NO: 89283 - protein, 32 aa, Zea mays
  misc_feature: Ceres CLONE 1576882
MVSGVYSDDYNLQLEATTQLRKLLSIERSPPS

SEQ ID NO: 89284 - DNA, 994 bp, Zea mays
  misc_feature: Ceres CLONE 1576887
  misc_feature (806)..(806): n is a, c, t, g, unknown, or other
  misc_feature (887)..(887): n is a, c, t, g, unknown, or other
ccccgcggtggcggccgctctagaactagtggatcccccgggctgcaggaattcgtctcacccctagaaaaaaaaaaaaaaccggtggtcgctctcggcctctcttctagtccgtctctcccacagtccagtagcacctatggcagctagggtttgcgtaggcggttgagaactcacgcgccaagactacatgggctccatccccactcgcccaagctgaattgcctccatccccactctttctcaactcgctgggacgtgtcggcagtggatacagagccgagtgacgcgatctgcagctactaaggagagaggtaagaggaagaggagacgcctccatcgtctgctttgacgcggtgccacggacgtgggtttcttcgtgtttaaacctcccctccgcaccatgcatgtgccgcccgacggagggcgtgggtttcttcgtgtttaaacacatcgctgacgccacgccaagcctggtagcagttcgcgcagcgtcaccaaccgaactctccaaccctctatcaaaggagctgagctgcgagcctgcgactgcgacttgttggggaccctgcctgagcactgaacttggttctgtgcagtgtcaaccttgttcggcttgctggaaagggtgtggactctgcctggaatagaagttcagacaactgaaacacggacctgcacgttactagttcagttcagatacagagactaacaggttacaaattcagaaagtccagattcctaaactatacaaacactatcgtctcgtgaccatttttatctaactaatgagcaccgtcttctcngtatacgtgatcagcagactacgaatatgcagtgatcagactatccttatagcgtggagccatgctgagggatgcaaactntcttactactttcgagtcgtccgaccttgtaaaaacctactgctaaactacgttctcaattaaaatgcccggatcccccaaacgacattgctccctgaacactggaa

SEQ ID NO: 89285 - DNA, 805 bp, Zea mays
  misc_feature: Ceres CLONE 1576889
  misc_feature: Encodes the peptide sequence at SEQ ID NO. 89286
ctccccgcggtggcggccgctctagaactagtggatcccccgggctgcaggaattcgtctcacccctagaaaaaaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcatctacctcctcagcttcttcgggatcgccttcgtgcagtccgtcgtctccaacagcgacgacgaggaggacttcatcatcgactcccgccacggaagggcgcgggtgccggcgccggccgggccggggggccccgtgtgcgctgctggggagccccgccgcccccgccggaaaaaatgccggaggaggacgaggaaatccgtggtcccgggtcgtgggcaggaaaaatcccattccaacgggctgggaaacaaggctggggaaaattgccccccggggcccccgggattaggggggggaggccctctccccagggaaccccggggaaggggaaatgtgacggggcctcccccccccatagggggggta

SEQ ID NO: 89286 - protein, 215 aa, Zea mays
  misc_feature: Ceres CLONE 1576889
  misc_feature: SWISSPROT Homolog: EC 1.1.1.34 Hydroxymethylglutaryl-CoA reductase (NADPH)
MAMEVRRRVPPPHGSAPRRQQATGGEGQRVRVQAGDALPLPIRHTNLIFSALFAASLVYLMRRWREKIRSSTPLHVVSLAEIFAICGLVASLIYLLSFFGIAFVQSVVSNSDDEEDFIIDSRHGRARVPAPAGPGGPVCAAGEPRRPRRKKCRRRTRKSVVPGRGQEKSHSNGLGNKAGENCPPGPPGLGGGGPLPREPRGRGNVTGPPPPIGGV

SEQ ID NO: 89287 - DNA, 841 bp, Zea mays
  misc_feature: Ceres CLONE 1576890
  misc_feature: Encodes the peptide sequence at SEQ ID NO. 89288
ggagctccccgcggtggcggccgctctagaactagtggatcccccgggctgcaggaattcgtctcacccctagaaaaaagcctgaaaccaggggaaaccgaaccaccacggtcaactatctatctatctgcaatctccatccatctcctcccacacccactgaccaaccacagcacagcagcctcaagatgctttacatggtgtagccggcaagaaccttccctcccgggcgcaaaggggctctctctcctttaatttccttcaagaggggatagatagcccctctttcccccacctgcatcttccctccggttgcgcgctgtccctcttgttggttcttggcatcgatcgtcggttttcgcgccgcctgcggaaatggcggcggggctgctgctcaagatggtcggcttctgcttctgggcgctcttctggctcgccggctccgccaccgtgagcacgaccacccccgccctcgccggcggcggcgaggcggtggtcgtggacccccggtcagccatcgccgtcacggacgacgacttcgtctgcgccacattggactggtggccgccggagaaatgcgactacggcacctgcagctggggcctcgcctccctcctcaacctgaatctctctaacaaaatcctggtgaatgccgtcaaagcgttctctcctctgaagctccggctgggcggctctctgcaagacatgctgatatacggcaccggcgacactcgccaggcgccctgcgccccgttcgtgaagaacgcgtcagccatgttcggtttctcgcagggctgcctgccgctgcgtagatgggacgagctcaacgcgtttcttcaga

SEQ ID NO: 89288 - protein, 155 aa, Zea mays
  misc_feature: Ceres CLONE 1576890
  misc_feature (33)..(155): Pfam Name: Glyco_hydro_79n Pfam Description: Glycosyl hydrolase family 79, N-terminal domain
MAAGLLLKMVGFCFWALFWLAGSATVSTTTPALAGGGEAVVVDPRSAIAVTDDDFVCATLDWWPPEKCDYGTCSWGLASLLNLNLSNKILVNAVKAFSPLKLRLGGSLQDMLIYGTGDTRQAPCAPFVKNASAMFGFSQGCLPLRRWDELNAFLQ

SEQ ID NO: 89289 - DNA, 1100 bp, Zea mays
  misc_feature: Ceres CLONE 1576891
  misc_feature: Encodes the peptide sequence at SEQ ID NO. 89290
  misc_feature (63)..(63): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (75)..(75): n is a, c, t, g, unknown, or other
  misc_feature (76)..(76): n is a, c, t, g, unknown, or other
tggggaggtatgtaataggaccatctgcgggagcccttgtttgtggtggtgtggggtttctcnctcgatnnnttnntcaagctggaactccccgcggtggcggccgctctagaactagtggatcccccgggctgcaggaattcgtctcacccctagaaaaaaagaatcgggtcacatcgggccatcgggggagccagggacctcacgctcctccatggacgaggaggagcacgaggtttaccgtcagcacatccccgacgactcgcgacatggcacggcactgacatcgatagggctgcctccggcgatgacgcggcgaatctgcacgagctcgacgagatgaactgcaggctgaaggagatggaggaggaacgcctcgccctccgcgatatgcaggccaatgtccccaaagatatgcaaggaggagacccctactgcatctaacagctgacgcaaaggagcaggtgcatgcccgttctgtgtatgttggaaatgtgaattatgcatccaccccaaaagacgtgcaacaccattttccaaggcttgtgggaactgtccaccggggggaccatctttgaccgataagtttgggaagggccaaagaagttttcccctatggctgacattctctggaaaacatgaaaggtggttcggggaaaccctctttcaacctttggaagccactcctgaaattgggggtgggtacgcccatggaattaaaaggggccgctcctccacgaaggagggcacctcaactggttgtcccgtgggggatggaaaagccggggggcttcttcaaccaagcaaagggggggatttaaaatcccccataaccccccgggacgcaaccccccttttgttgcgatgtcttgacgccggtggtccaccctcttaatttccccgcccacccaagaatgggttatctcgggggaagggcccccccctggggaagttcacgcgccccccgccaatttggccgcccccaacaacctcttaaacatatttataaataataaccgggggcacggggggtaaaattacaattctcttagaggtccaaaaacctcagccttctgggagggaacggggggtcccacatg

SEQ ID NO: 89290 - protein, 34 aa, Zea mays
  misc_feature: Ceres CLONE 1576891
MNCRLKEMEEERLALRDMQANVPKDMQGGDPYCI

SEQ ID NO: 89291 - DNA, 825 bp, Zea mays
  misc_feature: Ceres CLONE 1576893
  misc_feature: Encodes the peptide sequence at SEQ ID NO. 89292
ctggagctccccgcggtggcggccgctctagaactagtggatcccccgggctgcaggaattcgtctcacccctagaaaaagcgattccgcccccagctaatcttctcctatctctcccgctccactcctaaacccagaacccagcccgccgcaaccctaaccgccgccgccgcgcgccgcaagcaccacaccactgccgtcgccacccccatggccgcgccgtcagaggacgcgttgcggggcgcgctcgcagctcgcaaagctgctgtggacgcgcaagacgagggcgtgcgcgctctcatagccagcggcggcacgtccaaggccgacgtggacgctgcggtcgaggcgctgaaagcgcttaaagctgaggccggcgccgccgcgcgcaggttgcaacacgcagtcgggggcagcgcgggtggcacctcccagggaggagctgcaacaagaggcggtgaacacgctggaacggaaactgttctacataccgtaccttcaaaatccacctcggtgatcccgggggatctaggactacaggacccccccgggggccgcggtaaaagccaaaagaagcttttctttctgggcggcagaaaatttggtctggaaaaaaaaaattggtgggaagggtaacctgccccctggttggaagacaaaaaaatgttcttgaaaaggatccagggcactggggaagaaagtttccgggacccccggggttaacggcgggggaaaacagggcccctgacccacaggtctcaaccccaaggggaaaaaaaaatttttgccacgggggaaccccctggaaaaaaacttttgccctgg

SEQ ID NO: 89292 - protein, 141 aa, Zea mays
  misc_feature: Ceres CLONE 1576893
MAAPSEDALRGALAARKAAVDAQDEGVRALIASGGTSKADVDAAVEALKALKAEAGAAARRLQHAVGGSAGGTSQGGAATRGGEHAGTETVLHTVPSKSTSVIPGDLGLQDPPGGRGKSQKKLFFLGGRKFGLEKKNWWEG

SEQ ID NO: 89293 - DNA, 1333 bp, Zea mays
  misc_feature: Ceres CLONE 1576895
  misc_feature (74)..(74): n is a, c, t, g, unknown, or other
  misc_feature (75)..(75): n is a, c, t, g, unknown, or other
  misc_feature (689)..(689): n is a, c, t, g, unknown, or other
  misc_feature (746)..(746): n is a, c, t, g, unknown, or other
  misc_feature (805)..(805): n is a, c, t, g, unknown, or other
  misc_feature (884)..(884): n is a, c, t, g, unknown, or other
  misc_feature (885)..(885): n is a, c, t, g, unknown, or other
  misc_feature (953)..(953): n is a, c, t, g, unknown, or other
  misc_feature (1111)..(1111): n is a, c, t, g, unknown, or other
  misc_feature (1154)..(1154): n is a, c, t, g, unknown, or other
ttgaggttgtctttttcttttattactttccagtacttgtgttccatagttttcttattgttattttttttttnncaaactgggactccccgcggtggcggccgctctagaatagtggatcccccgggctgcaggaattcgtctcacccctagaaaaagccaagaagccaagcccatccgatccggccccggctgccctgcccgagctcgtctctcaggtcgccttgccgttgccggttccgcgcccggctcagagtcgcgagctcgtctcgcagatccgttttcgcttgcttgaattctgttctttgggagcaaagaggtgctggccggtggcgtggcttggtgctctggggccggcgagttttttttgcgtccgctcgctctgcctgtagtcttcttgctgcggcggcagggtggagatgggggtggcggggagagaagtttttgttggggaaagaaagggggcttaatcgcccccacatgtctttcgtcatcagtcttcatttgcaggcgggaacccaggaaactccatctggctgtcaaattccccctctttctatttaaagaagtagccaccttctgggattgcaacgccctaatcttcttctcctgaagggtaaataccgccatcacaaaaccagcggagtcaaatacatgaacctctttataccaagtgtcagacaaaagtnccccccatgacgctaatatttctagcagagagtgttctttaacgcggcaacactacncaccgcattttgctcaaacatttcaacccgtaacaacacggcacgccataggttttgcnggtgtgtgattatccccccctcatctatttcatcgtgatttgtgggcactgggtcgtcccacaacaaaccgattgacannaacaaatgattaaataccatctccatgctagtaccgcttttctctcctctctttaaacactttttttntttgtcaccaagcgatgtactaacacccctacttactgtcctcgcgttgcggatcatcactgatgttatcgccaccgcaggcgcgcccgtatcgccggccgtaacagaagaccaataaactctttcgcgtcgatgacgtagtatatggtatgtgtgtnggaagtaccctcatcgtccgatggagcagtggtgagctacagnccaactattccaggcgcacagtatacacacgcacgatctacctatacaatgaatgaacgacgaaacagtaagcacgctactctccctcctcgtgagacgttgaatacacaaattgtaagtagaactgctagctcgcgcgcgcagaagcgatgtggacgccgatccaggtaatgttccac

SEQ ID NO: 89294 - DNA, 754 bp, Zea mays
  misc_feature: Ceres CLONE 1576897
  misc_feature: Encodes the peptide sequence at SEQ ID NO. 89295
ctccccgcggtggcggccgctctagaactagtggatcccccgggctgcaggaattcgtctcacccctagaaaaattttccccctcctctcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcagggccttcgacgcgcgcacccaccgcgcgctcgactcgctccaccgccgggaggcctccatcgacgcctccgtctcgcgcgcgctcgaccacctccactccatctccgcctccgcctccgccgccgccgccgcttcctccaaggcccccgccacctccgactccgactccgagggcctcgccgagagcctgcgcgcgctgtgcgcgcggatggactccgccgcgttcctgggcttcgtggtggcccgccggcaggaagcggacgcgct

SEQ ID NO: 89295 - protein, 168 aa, Zea mays
  misc_feature: Ceres CLONE 1576897
MASPAAAAAAAPPPAAKEKEKDAEEAPVTGDMVSAGFAELERQQQLLATCTRLYQQLSDHFGSLERGLAARSDALRVRRRAFDARTHRALDSLHRREASIDASVSRALDHLHSISASASAAAAASSKAPATSDSDSEGLAESLRALCARMDSAAFLGFVVARRQEADA

SEQ ID NO: 89296 - DNA, 850 bp, Zea mays
  misc_feature: Ceres CLONE 1576903
  misc_feature: Encodes the peptide sequence at SEQ ID NO. 89297
gagctccccgcggtggcggccgctctagaactagtggatcccccgggctgcaggaattcgtctcacccctagaaaaattaattccgtccacagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaaaccaggcagtgtcatattgggtgctgatggtaacctcacttctaactgttcttcccggggaaaaagaacagggcttggtttccctgccccccgttaagaacacttttcaaggcttggcgaaaaggaagaattgttaattccttcccgggaattatttggttgaatctccccccaccccccacgacaaggggactagggaaggaacttcca

SEQ ID NO: 89297 - protein, 166 aa, Zea mays
  misc_feature: Ceres CLONE 1576903
  misc_feature (18)..(167): Pfam Name: PK Pfam Description: Pyruvate kinase, barrel domain
  misc_feature: SWISSPROT Homolog: EC 2.7.1.40 Pyruvate kinase
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILGADGNLTSNCSSRGKRTGLGFPAPR

SEQ ID NO: 89298 - DNA, 804 bp, Zea mays
  misc_feature: Ceres CLONE 1576912
  misc_feature: Encodes the peptide sequence at SEQ ID NO. 89299
  misc_feature (371)..(371): n is a, c, t, g, unknown, or other
tggagctcaccgcggtggcggccgctctagaactagtggatcccccgggctgcaggaattcgtctcacccctagaaaaactccactccactcgcccgcgcccgccgcccgcgtgctcctccctcgcgcccgccccgccccgctccgcccctatctatatccattcccgctcgtccccctcaacaaccctcctcaccgcgcactcgtgttcgtgtcatcccgcccgcaggccgcagtccatggccaccgccagcctcgcgctctcgctgcgcctcgcgccgtcctcgcgcccgctgagcctccgccgccggggggccgccggcgtcacctgccgcgccaccaccgccacgttccaccagctcgacgccgtcncggtgagggaggaggagtccaggttccggacggcggcggcggagggccgcaacctgctgccgctcacgaagtgcatcttctccgattacctcacgcccgtgctagcgtaacgctgtctcgtttaagaggacgaacgcgatgcgcccagctttctcttccagtctggcgagcagggggtccaagggcaccaatggtggggaaggtcaagcggggccgggggccccacccttcaatgggaggggcgggggccaaggggtaaaccatgtgggacgggccattgggacccttgaaaaaagaaaattccaaggaagggggacccccctttcgggggcccggataccccctgggggggaaatcccccggggaaaaaatctcctggggagagaaatggggaaaaacccgcccacaaaattgtggggtaaaaacagccctc

SEQ ID NO: 89299 - protein, 80 aa, Zea mays
  misc_feature: Ceres CLONE 1576912
  misc_feature: SWISSPROT Homolog: EC 4.1.3.27 Anthranilate synthase
  misc_feature (45)..(45): Xaa is any aa, unknown, or other
MATASLALSLRLAPSSRPLSLRRRGAAGVTCRATTATFHQLDAVXVREEESRFRTAAAEGRNLLPLTKCIFSDYLTPVLA

SEQ ID NO: 89300 - DNA, 988 bp, Zea mays
  misc_feature: Ceres CLONE 1576914
  misc_feature: Translation starting site: 182
  misc_feature: SWISSPROT Homolog: EC 4.3.1.5 Phenylalanine ammonia-lyase
  misc_feature: SWISSPROT Homolog: EC 4.3.1.3 Histidine ammonia-lyase
  misc_feature (783)..(783): n is a, c, t, g, unknown, or other
  misc_feature (825)..(825): n is a, c, t, g, unknown, or other
ctggagctccccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgtctgccgtcggaggtcacccgcgcggcgatgctggtgcgcatcaacaccctcctccagggctactccggcatccgcttcgagatcctcgaggccatcacgaagctgctcaacaccggtgtcagcccctgcctgccgctccggtgcaccatcaccgcgtcgggcgacctggtcccgctctcctacatcgccnggctcatcacgggccgccccaacgcgcatgccgtcaccgtcnaacggaagggaggtggacgccgcctatagcgttcaagatcgccggcatcgagggcggctttctcagctccaccccaggaagggctcgcatcgtcaacgcacgtcctgggctcgcgctcccggccacgtgatgtagacgccaacgtctgggcgtctgtcgaagt

SEQ ID NO: 89301 - DNA, 735 bp, Zea mays
  misc_feature: Ceres CLONE 1576916
  misc_feature: Translation starting site: 321
  misc_feature: SWISSPROT Homolog: EC 1.8.1.4 Dihydrolipoyl dehydrogenase
ctccccgcggtggcggccgctctagaactagtggatcccccgggctgcaggaattcgtctcacccctagaaaaagtccactcatctcagcagctgacctgacactgaacatgcgggtcccatcgccgctggccagcaacgcctctgccttcttccctcggcctccgccctctgctgctagtctgccagcttcgaaacctccgccccgtcgcataaacccctcctcgcctcctccgcccgagcctgcctcctcatcgacttatacgcctccttctcttaactcgacgcactagcctcagccatttgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggcggcggcgaccaatggcgcggcggcggggacctgcgggttcgactacgatctcgtcatcatcggcgcgggcgtcgggggtcacggcgccgcgctgcacgccgttgaagagggcttaaaaacagcaataattgagggagatgttgtggggtgggacttgtgtaaacagaggctgtgtcccatcgaaagcgcttcttgctgtcagcggtcgaatgcgggagcttcat

SEQ ID NO: 89302 - DNA, 950 bp, Zea mays
  misc_feature: Ceres CLONE 1576920
  misc_feature: Encodes the peptide sequence at SEQ ID NO. 89303
agctccccgcggtggcggccgctctagaactagtggatcccccgggctgcaggaattcgtctcacccctagaaaaaatatctagttgctttctggttcttttccggcccagtgggaggaaccccgacaaacagaaatcaaaggataacacttggatgcctcatacgatctctgatgattggcctttttttatgttctagagaagatgtgtgcttggtgccctgctggtgtcatcgcctgtgatggagtgcgcctgggacctctgtaggaccgccagagtatcaacgcccaggtccccgttccgataggacggctgtaagatatatgtggggctctccggggtgcacgctgcggtgtctgcatctcgtgcgttggtgacccgtggtggtcaccgatctctctcgagcggtgggagatctgacgggacgcggcggtggccggatgttccggcccttgctcgggggcgaatctgactcttccgctgctggggactatgttgccctgaacgcgctggcactgcactgcttattgaaactctgcggctaccgtgatctcatgatgcttctgaatgagatcaggggtaaggctgtcatgttcatcggcaagtcccgcggtggcaactttgtgacaatcccagtgctacactacatgaggatatcgtcttcaatgtcaccatggtgacatggtctgcctgatctgatgcgtgacgcttaggagcgcgctactaagcaaagagtgtctgcccaggataatgctgcaagagcaatgtggtcggctacttctgccacgttgccactcatgatgaaacgtcactaggatccgtactgacacccgtgatgcgtccactcgcatggtatgatcgacatgcactggatcgatgaatgtacagactcacccactaggtgaggtgagacgtgtccacctgcatgtgggacgtgactaaactgctgg

SEQ ID NO: 89303 - protein, 79 aa, Zea mays
  misc_feature: Ceres CLONE 1576920
MFRPLLGGESDSSAAGDYVALNALALHCLLKLCGYRDLMMLLNEIRGKAVMFIGKSRGGNFVTIPVLHYMRISSSMSPW

SEQ ID NO: 89304 - DNA, 856 bp, Zea mays
  misc_feature: Ceres CLONE 1576922
  misc_feature: Encodes the peptide sequence at SEQ ID NO. 89305
ctccccgcggtggcggccgctctagaactagtggatcccccgggctgcaggaattcgtctcacccctagaaaaactggcgcggacgcgcggtggcgccgtcgccgcctcaatgcagttcggaacgccgcttcctccggccgctcggcgcgcacccaccttccacgcagaccccgccgccgacgcgaggcagctcctcggcgcgctcctgccgccacgccctgcgctctaccacgttttgcaggcccacgcccgcctcgccgttctcggcctcgctaccgcgcgcgccctcccgcaactcctcgccgcccttccgcgcctgacgctcgccgccgccgacgtttcccactcctacccgctcctcctgttccgttgctccaactgtacctcggccttcgcgtcgaaccacctcctccgcgtgctcccgcacccgctcccgctccgcctcttcccgcgcctcccacgccgcaacccccactccttcactttcctcctcgcttccctctccaatcacctagacactgagcctgccgctgcaggctccatcgcctcccgcttcatgggaacccacgtgcacgcgctggccctgaaggctggcgcccccgggcgaactggacgtggcgtaacgcccagaaccacttttaccgcctcccgccgaaaacgtggcgggcaaatccgagaaggggttccaaacaaacattccccttccgggcgggaaaatggggggaacagggaaatgcccggccccccgacgggttaacttggcgaaacccggccatggggggggggggtttacccacccgggaagggggtgttcaaaccgaaatggtcccccttttatagggtgaaaaaggggat

SEQ ID NO: 89305 - protein, 215 aa, Zea mays
  misc_feature: Ceres CLONE 1576922
MQFGTPLPPAARRAPTFHADPAADARQLLGALLPPRPALYHVLQAHARLAVLGLATARALPQLLAALPRLTLAAADVSHSYPLLLFRCSNCTSAFASNHLLRVLPHPLPLRLFPRLPRRNPHSFTFLLASLSNHLDTEPAAAGSIASRFMGTHVHALALKAGAPGRTGRGVTPRTTFTASRRKRGGQIREGVPNKHSPSGRENGGNREMPGPPTG

SEQ ID NO: 89306 - DNA, 826 bp, Zea mays
  misc_feature: Ceres CLONE 1576924
  misc_feature: Encodes the peptide sequence at SEQ ID NO. 89307
  misc_feature (746)..(746): n is a, c, t, g, unknown, or other
cggtggcggccgctctagaactagtggatcccccgggctgcaggaattcgtctcacccctagaaaaacttctcccccatctccatttttctcctcccactgattttgcattttagcccctcaggaagctcggatttcggccccgctccggcggaccgcttccgttcgtgctctgctccgaccgagcgcgccgcgccgtggggggcagctgcgaggactctcgttcggcggctctggttctcggcttggtcccgtttcttccccaacaaatctcgtaatttttcgtccagatttggcttctcgccgcccgtctgggtctttctcgtgcgtttcgcctttggtttcgccgatttggtgccggattcggtgggttgcggccgagtagcctggatctcgggcgcgggtctagcgctaggagccctcacactggggatttcctgccggaggaagcttttcaagggagctagcagctagtagctagctgcctttgggagcagtagctcttctagtctctgaaggtttcaccatacgcggtggagagcgctattagcttgaggagtagatttcgtgtagcggtgagcaaagtttgggtgtcaagtctggtggtggaagccttcaggcttgagatttttctcaaggagcacgccgtctctgggagggatttcctgccatccagaggctgccgatttcctcccttccggggagcagcaagggcttttctctagacgagctcttctgggttccttnagtttggggggccggggctatttaatctccaactgcatccccggatattcccaaattcctggtgaaactggggacttcca

SEQ ID NO: 89307 - protein, 37 aa, Zea mays
  misc_feature: Ceres CLONE 1576924
GGGRSRTSGSPGLQEFVSPLEKLLPHLHFSPPTDFAF

SEQ ID NO: 89308 - DNA, 842 bp, Zea mays
  misc_feature: Ceres CLONE 1576925
  misc_feature: Encodes the peptide sequence at SEQ ID NO. 89309
  misc_feature (543)..(543): n is a, c, t, g, unknown, or other
  misc_feature (544)..(544): n is a, c, t, g, unknown, or other
  misc_feature (612)..(612): n is a, c, t, g, unknown, or other
  misc_feature (679)..(679): n is a, c, t, g, unknown, or other
  misc_feature (683)..(683): n is a, c, t, g, unknown, or other
  misc_feature (723)..(723): n is a, c, t, g, unknown, or other
ctccccgcggtggcggccgctctagaactagtggatcccccgggctgcaggaattcgtctcacccctagaaaaagctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacacgtccgcgctgatgcagcagaacgcgccgctggcctcgtccaagccgtccgtgccggagacggagaccatccctccggaagagacgctggacgacggcgacggcgcggataccggcgatctgcgtgggacggagcccggctttgcggaagctgccgtcatgaggaacgacatggcagcggggtccgacgagccctgcttgccnnacaggaaggacggctgctgtaatgcggaggccgagcccacaacaagccatctgaagatggcaacggcngccaaccaggaggcagatgacgtgcgacgaagaacgcgtggaacgacgggtttccgtacccccggcnaacngtgtgcgacctgtccgggaacttgcccttgacccgaaccnaaagaacgggttaccggggaaaccctcccggcccccccccggggggttccaacaaaagcctaaaaaaacgctcccaacgttcccccccaagggaaaccccccaatggcccactaaaggg

SEQ ID NO: 89309 - protein, 196 aa, Zea mays
  misc_feature: Ceres CLONE 1576925
  misc_feature (141)..(141): Xaa is any aa, unknown, or other
  misc_feature (186)..(186): Xaa is any aa, unknown, or other
  misc_feature (187)..(187): Xaa is any aa, unknown, or other
MASTAYSRSSSNKLPGGERRLPPRLMRGLTSKFEPKKLGVGLVAGCCLALLTYVSLAKLFAVYSPVFASTANTSALMQQNAPLASSKPSVPETETIPPEETLDDGDGADTGDLRGTEPGFAEAAVMRNDMAAGSDEPCLPXRKDGCCNAEAEPTTSHLKMATAANQEADDVRRRTRGTTGFRTPGXXCATCPGTCP

SEQ ID NO: 89310 - DNA, 868 bp, Zea mays
  misc_feature: Ceres CLONE 1576927
  misc_feature: Encodes the peptide sequence at SEQ ID NO. 89311
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (754)..(754): n is a, c, t, g, unknown, or other
  misc_feature (759)..(759): n is a, c, t, g, unknown, or other
  misc_feature (824)..(824): n is a, c, t, g, unknown, or other
  misc_feature (826)..(826): n is a, c, t, g, unknown, or other
  misc_feature (829)..(829): n is a, c, t, g, unknown, or other
  misc_feature (830)..(830): n is a, c, t, g, unknown, or other
  misc_feature (853)..(853): n is a, c, t, g, unknown, or other
ctggagctccccgcggtggcggccgctctagaactagtggatcccccgggctgcaggaattcgtctcacccctagaaaaactctcccccttctctcgcgcggcaactgggccatcgccgccacccctacccaggtcttcgtcggtcgcttcgccagccgccaggtcttcgtcggcccatcccccggtcttcgtccttcaatcctccggcgacgagcacccaccagaggctgggaactccaaagaggaacagggtccatggctggaggcgcaggaaatggttcgaacgaggcggtgcaggcaaaggggaagtgggggtgatagctccgccgccaagccgctgcccccttgctgcgtcaaggcgagagcggcggcgcccgagtctgaggccaagtgccatgccaccgtggtttcgggatggttcaccgagccacgatcacactgcggtaaagccagcaaggttcagtattacaataacccaatgtggccaggagaggcccattccttgaaagtggagaacatattgtaccaggggaaatcaccataccaggaagtcctggtctttgagtcgtcaacctatgggaaagtccttgtgcttgatggtattgttcaattgactgataaggatgaatgtgcgtaccaggaaatgattactcacctcccactctgttcaattccatcccctaaaaaggttttggttattgtgtgggnnnaataaaggagaggtaaaacttcagagagatttccagacacagnttcangtggagtctatttgacaatatgtgaaaattgatcagctgggttattgataatctgcaagaattcntnccnnacatttgtctgtttgggatttgnaagaatcctcgtgtt

SEQ ID NO: 89311 - protein, 144 aa, Zea mays
  misc_feature: Ceres CLONE 1576927
  misc_feature: SWISSPROT Homolog: EC 2.5.1.16 Spermidine synthase
MVRTRRCRQRGSGGDSSAAKPLPPCCVKARAAAPESEAKCHATVVSGWFTEPRSHCGKASKVQYYNNPMWPGEAHSLKVENILYQGKSPYQEVLVFESSTYGKVLVLDGIVQLTDKDECAYQEMITHLPLCSIPSPKKVLVIVW

SEQ ID NO: 89312 - DNA, 844 bp, Zea mays
  misc_feature: Ceres CLONE 1576928
  misc_feature: Encodes the peptide sequence at SEQ ID NO. 89313
gagctcaccgcggtggcggccgctctagaactagtggatcccccgggctgcaggaattcgtctcacccctagaaaaagctggccgctgctctcttcctccctcctcctcggtccactccaaccccaggcctgccgcggccacagacgggccgcgccgccgccgcagcttccgattccgcttccgccggccgttctgccgcgcgcgcgcctgtggcgcttgagcgggcggatttgttcggcccgttctttggccgccgccgttgcgctgcgccgtgttggcttccagttcccatccaggcgtcttgagattccccggccggagatctgcttaattcgtacctctctctggttctgaggcccctccgaggtggaggaggagctcgtgggtcgacgaaagaacaatcgtttctttgcccactcctgcggctgcttctccgtcccaggctttccagccatggaggaggtggaggtggccaacatggccgcggtggagagctgccaccgggtgctggctctgctctcgcagcagcaggacccagccctgctcaagagcgtaacttcagagacggctgaagcctgcgccaagttcaggaaagtagcggccttcctcggcagtgccaatggcgggaggtggctgtggccatgctagaaggcgggttctcagaaaagtcccggcctcgggggctcgtcaaccagaagaaccccttgggggatccgcaaccgggagcggcaaacccgctgggaaaataaggcccaacaacagctggctgctggctgggggcctccaatcctccccctccaagtcgaattaagcttaagcgccaaatgggccccttccgggttc

SEQ ID NO: 89313 - protein, 64 aa, Zea mays
  misc_feature: Ceres CLONE 1576928
MEEVEVANMAAVESCHRVLALLSQQQDPALLKSVTSETAEACAKFRKVAAFLGSANGGRWLWPC

SEQ ID NO: 89314 - DNA, 798 bp, Zea mays
  misc_feature: Ceres CLONE 1576929
  misc_feature: Encodes the peptide sequence at SEQ ID NO. 89315
ctccccgcggtggcggccgctctagaactagtggatcccccgggctgcaggaattcgtctcacccctagaaaaaattccactgttcgccctctctctcttacgcgcgcgtgacaacctccctccctcctctgcgcgcgtgtcggaaacagcagcaggtacgcccccaggctgatctccggtgggccgtgcgctggccatctgacgcgtgcgcgccggtgatggcaacgccatccggcgagtgagggccgccgcgcccgagaggggtcctcctccgaatccgcagctgcgacgataggggtccactgggcggcaacaagacccatatcgccagtggcagcagattctggaagaagccgatgtactgcggccacaggctcaggctgctggtgatccacactgtagctaaaacacgaagactgtgccgtgcagagcttggaataacatgagacctaactcacgcgccagaaggaggcttgccgtttgcgggacgtcgacctccggagaatttccccgaagaagctggctcacgaaatggccatcccatcctaaaactaggacgccatcattctgcatcaacctgcacgtcatcttggttgcccatgaaaagcctgtactggccaattcataggtcagttggaaataaaccgaggacttcaccgcccccctccccaatggccaaataaagggggccttacctggcctcaagaaacacagccccgtgggaataggtttgggaaaaccaagattggcaccggtctacaccccatgtttcaaccaattgctccccccccgggggg

SEQ ID NO: 89315 - protein, 29 aa, Zea mays
  misc_feature: Ceres CLONE 1576929
MYCGHRLRLLVIHTVAKTRRLCRAELGIT

SEQ ID NO: 89316 - DNA, 808 bp, Zea mays
  misc_feature: Ceres CLONE 1576930
  misc_feature: Encodes the peptide sequence at SEQ ID NO. 89317
  misc_feature (600)..(600): n is a, c, t, g, unknown, or other
aaagctggagctcaccgcggtggcggccgctctagaactagtggatcccccgggctgcaggaattcgtctcacccctagaaaaagtaccatgcagcagctgtatgagagcctggtggtaggtaggataggagtagcgccagccgccaagtgcgcgtccgggctggctgcttcgacgagcaggagggagccgcacctccgggctcccgcaatgtcgcctcctccgcccccgccgctgctgcgcaacgagctgtcgcgcatgacggcggtgctgggcctgcgcctgtgggtgctggtgggcatcgccgtctgggccgccttcgtgctgctcctcgtgctcatctccctccacctcgccgcggcgcggcggaggcggcccaggaagggcgtcgcgcacgcgcacccccccacaccggcaggggcgccgccgctgtcaccgtccaccatcccgcccgtgtccaatgagatccatgaggtggccatccacgtcggctcgctccgccactacctcgagacggggcacgcgttcctcaaggacggcggcggcgactgccacagcgacagtgagtccgtggcgcacgggtcgcagcgcgtccacatcnaggctggtcagggccagcgcatggtcacggcggcttccgactcactgtcggcggccatgggccccaaggtgtctcacctcagctggggccactggtacaccctgcgtgcagctgaaggacgccaccgccgcgttcgccaccacagcacatccttctgcaaagggcggggtaccggatcgtcttgacggtgcggtccttagccgtacaa

SEQ ID NO: 89317 - protein, 231 aa, Zea mays
  misc_feature: Ceres CLONE 1576930
  misc_feature (171)..(171): Xaa is any aa, unknown, or other
MQQLYESLVVGRIGVAPAAKCASGLAASTSRREPHLRAPAMSPPPPPPLLRNELSRMTAVLGLRLWVLVGIAVWAAFVLLLVLISLHLAAARRRRPRKGVAHAHPPTPAGAPPLSPSTIPPVSNEIHEVAIHVGSLRHYLETGHAFLKDGGGDCHSDSESVAHGSQRVHIXAGQGQRMVTAASDSLSAAMGPKVSHLSWGHWYTLRAAEGRHRRVRHHSTSFCKGRGTGSS

SEQ ID NO: 89318 - DNA, 934 bp, Zea mays
  misc_feature: Ceres CLONE 1576931
  misc_feature: Encodes the peptide sequence at SEQ ID NO. 89319
ggagctccccgcggtggcggccgctctagaactagtggatcccccgggctgcaggaattcgtctcacccctagaaaaagcctagctgctccgcgccgagaggcggccgaggaggacgggcgatgtacccggtggtgacgggcacgccgccggcgcggctgccggcggcgtcgcgggtggacaaggccacgagccacctgctgcagggccccaactgggccgtcaacctcgaaatctgcgacaccctcaacgccgaccgctggcaaacgaaggatgtagtaaaagctgtgaagaagcgattgcagcataaggatccaaaagttaaattctttactttgacgttattggagacaatgatgaagaactgtggtgaatatgttcattttgaagttgttgatcagcatgttttacaagagattgttaaaattgtccagaagaggcatgatatgcaagtgagggataaggctttgttacttctggattcatggcaagaggcatttggtggacctggtggcaaatatccacagtactactggtcatacattgaactaaagagggcaggagtaatgttcccacaacgtcctgtagatgctcctccaatatttactcctcctgcaacacatcaggcatatggttcacctagatatccttctggaagtctaaatgacagaatcacatctgaagctggaacgttgagctttgagggcttgaataatattagaaatgcgacggaactgctgtatgatatggtgaatgctttgaaccctgctgaccccatggcaggtaaaaatgaaattattgcagatcttgtaaaacaatgtcgttcaaatcaacaaaaactcatgcagtttggcagttccaccaggggagtatgacctgcctaaggcagggactagaattaaatgatcgcttacagagggtcctaacaaaaacat

SEQ ID NO: 89319 - protein, 250 aa, Zea mays
  misc_feature: Ceres CLONE 1576931
  misc_feature (13)..(147): Pfam Name: VHS Pfam Description: VHS domain
MYPVVTGTPPARLPAASRVDKATSHLLQGPNWAVNLEICDTLNADRWQTKDVVKAVKKRLQHKDPKVKFFTLTLLETMMKNCGEYVHFEVVDQHVLQEIVKIVQKRHDMQVRDKALLLLDSWQEAFGGPGGKYPQYYWSYIELKRAGVMFPQRPVDAPPIFTPPATHQAYGSPRYPSGSLNDRITSEAGTLSFEGLNNIRNATELLYDMVNALNPADPMAGKNEIIADLVKQCRSNQQKLMQFGSSTRGV

SEQ ID NO: 89320 - DNA, 827 bp, Zea mays
  misc_feature: Ceres CLONE 1576933
  misc_feature: Encodes the peptide sequence at SEQ ID NO. 89321
  misc_feature (628)..(628): n is a, c, t, g, unknown, or other
  misc_feature (810)..(810): n is a, c, t, g, unknown, or other
ggagctccccgcggtggcggccgctctagaactagtggatcccccgggctgcaggaattcgtctcacccctagaaaaagccgcctcccaaacgcgtccaaaacattctgcggcctgttggagggcagcaccaagtatcacagtctagctactgcctggcaccagcaagcttctgccctgccccgccccgccgccagaatccgaaaccagtaaaccacagcggcaacaacctcgcggcgcccgcgtggaggcaggcggcgcataaagccagccggcgctgctcctgctgcttcttcgatcggtccatggctgtcgtcacgagggacgcggcgtgcctgcccctcgtcctcctgctcctagtcttctccgcggccccgtctccggctgacggctgcgaccgctgcgtgcgccggtccaaggccacctactaccaggcttcctcgctcgccctcaacgccgggtcgtgcgggtacggctccttggccgcgtccctcaacggcggcctgctcgccgcagccagccccgagctgtacaggggcggcgtcggctgcggcgcctgcttccaggtgcggtgcagggacagcgagctgtgcagcgccgccggcgccaaggtggtggtgacggaccangcgcggacgtcgaaccgcacggcgctggtgctgagcgccgcggcgtacgcggccatggccagtgcccggcaagccgcgcgcctcagggaccggcgcgtcgtcgacgtcgagtacaagagggtaccctgcgagtacgcgaaagaccgcaacctgtttgatacgcgtggaggaagaagaccggncgccaaagcaccctgta

SEQ ID NO: 89321 - protein, 174 aa, Zea mays
  misc_feature: Ceres CLONE 1576933
  misc_feature (68)..(146): Pfam Name: DPBB_1 Pfam Description: Rare lipoprotein A (RlpA)-like double-psi beta-barrel
  misc_feature (108)..(108): Xaa is any aa, unknown, or other
  misc_feature (169)..(169): Xaa is any aa, unknown, or other
MAVVTRDAACLPLVLLLLVFSAAPSPADGCDRCVRRSKATYYQASSLALNAGSCGYGSLAASLNGGLLAAASPELYRGGVGCGACFQVRCRDSELCSAAGAKVVVTDXARTSNRTALVLSAAAYAAMASARQAARLRDRRVVDVEYKRVPCEYAKDRNLFDTRGGRRPXAKAPC

SEQ ID NO: 89322 - DNA, 787 bp, Zea mays
  misc_feature: Ceres CLONE 1576934
  misc_feature: Encodes the peptide sequence at SEQ ID NO. 89323
ctccccgcggtggcggccgctctagaactagtggatcccccgggctgcaggaattcgtctcacccctagaaaaaattttccaagggctctacacgaagttaggcggccaagtgttcgcaaccaacccctcttcctcgcccactgaaaggttcagaggctcccgttttagcatagcgaccgagacgaaagagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccagggttcccgggcggcgccgaagcgttcgaggcctgcgccaagtactgctacagcatcaccatctcggtgagcgcgcgcaaacctggtcccgctgctgtgcgcggcggcgcacctcggcatgtcggatgccgccgacagggggcaactcgcgggcaagcttccgacacgttgctcgcctcctgcctcctgcgccgatggaaggacgcgctggggggggttcaactccaggcgccaacaaggcccccgttttgggaaggacctggggcctccacttccccgccttcgtttcgaacacgtggggcggcccctcgttctccaggcccgggaaacccgccccccggaagtgcccaaagtgg

SEQ ID NO: 89323 - protein, 187 aa, Zea mays
  misc_feature: Ceres CLONE 1576934
MKFMRLGTRPDTFFAAADSVRSVCTEVATDLQILVDNCLYHLHKFPLLSKCMLLQALCADAGDVVVELPGFPGGAEAFEACAKYCYSITISVSARKPGPAAVRGGAPRHVGCRRQGATRGQASDTLLASCLLRRWKDALGGVQLQAPTRPPFWEGPGASTSPPSFRTRGAAPRSPGPGNPPPGSAQS

SEQ ID NO: 89324 - DNA, 858 bp, Zea mays
  misc_feature: Ceres CLONE 1576935
  misc_feature: Encodes the peptide sequence at SEQ ID NO. 89325
  misc_feature (483)..(483): n is a, c, t, g, unknown, or other
  misc_feature (489)..(489): n is a, c, t, g, unknown, or other
  misc_feature (541)..(541): n is a, c, t, g, unknown, or other
tccccgcggtggcggccgctctagaactagtggatcccccgggctgcaggaattcgtctcacccctagaaaaagtcacgactcacgaggggactcccgagcgcacgcgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttaatctggatgaaaatccagtagtaagcaataagaattccagaaaagatcttgtagtagaaattgatcctgtcaatnatgaangacgggaaaaagttaaagaggcaatgctccatgcttgggaatttctatgttnagtatgcctgggggaatgaacgagctttcacccacatccgagaaatggtttcaacagcttttgggtggcttggaaccacccttgttgactccctgaataccctattccttatggggcctgaaagatgatttccaaaaactaaaaacctgggtgggcggattccttaaactttgaaaggatttttatttcgcaggttttttaaccaacccttagggttttttggagggcccccttaattcatccaaactttcggggggaaaaagtattttcgggaaggggcaaaattttcccaccccccccttcccccgtggggaaca

SEQ ID NO: 89325 - protein, 125 aa, Zea mays
  misc_feature: Ceres CLONE 1576935
  misc_feature (101)..(101): Xaa is any aa, unknown, or other
  misc_feature (103)..(103): Xaa is any aa, unknown, or other
  misc_feature (120)..(120): Xaa is any aa, unknown, or other
MARRSSSSSSGTWRYLNPAYYLKRPKRLALLFFVFVAATFAFWDRQSLVSEYESEISRLEDDINRLHDQLRKAGVNLDENPVVSNKNSRKDLVVEIDPVNXEXREKVKEAMLHAWEFLCXVCLGE

SEQ ID NO: 89326 - DNA, 883 bp, Zea mays
  misc_feature: Ceres CLONE 1576947
  misc_feature: Encodes the peptide sequence at SEQ ID NO. 89327
ctggagctccccgcggtggcggccgctctagaactagtggatcccccgggctgcaggaattcgtctcacccctagaaaaaagctctactcaaagagcgctctaccagtacaactacaaccacactaaaacccaaacaaaaaaaaggaagcaggtgctgccgatatatcgattgatcgatcatggcggcggccgtggccaatatcggcatggagtggctccaagaccctctgagctgggtgttcctgggcacggtgtgcttggtggtcctgcagcagctgcgacgtcggcggggcaaagcgccgcttccgcctgggccgaagccgctgccgatcgtaggcaacatggggatgatggaccagctgacgcaccgcgggctggcggcgctggcggagacgtacggcgggctgctgcacctccggcctgcgaccgcggccatcgcgtacctgacgtacgaccgcgcggacatggcgttcgcgcactactggcccttctggcggcagatgcgcaagctgtgcgtgatgaagctgttcagccggcggcgcgccgagacgtgggcggccgtgcgcgactagtgcgcggcgctggtccgggccgtatccgtgtgcgggggcgggggcaggggctaggccgtgaacctgggcgagctcatcttcagcctgacgaagaacgtgacgttccgcgcggcgttcggcacccgcgacggcgatgggccagaggagttcatcgccatcctgcaggagttctcccagctgttccgcgccttcaacgtgggcgaactcctgccgtggctgggctggatgaacctgcatggaatcaacccgtggctggacgccgcccgcttccggctggaacggttcatcgacaaatcatcgaccatcactg

SEQ ID NO: 89327 - protein, 130 aa, Zea mays
  misc_feature: Ceres CLONE 1576947
  misc_feature: SWISSPROT Homolog: EC 1.14.13.68 4-hydroxyphenylacetaldehyde oxime monooxygenase
MAAAVANIGMEWLQDPLSWVFLGTVCLVVLQQLRRRRGKAPLPPGPKPLPIVGNMGMMDQLTHRGLAALAETYGGLLHLRPATAAIAYLTYDRADMAFAHYWPFWRQMRKLCVMKLFSRRRAETWAAVRD

SEQ ID NO: 89328 - DNA, 855 bp, Zea mays
  misc_feature: Ceres CLONE 1576948
ctggagctccccgcggtggcggccgctctagaactagtggatcccccgggctgcaggaattcgtctcacccctagaaaaaatatggctacaccctcccgataggtcttcttcctcgcgctctcagcttaccccaccacaggtgagggaggcgactccttcctcgcggctacccgctccggccccgatcgcgtctcctttgcacgccacggcccgcgcgcagtgtccaccggcacggccgtcctccgagtgtgggggcgcgtctggtgctagcttgccgggctagggtttgagcgtggactcgtctgccgctccgtctcgtctgataggcacaggttgcgagcacgagaacgtcgtcgctccctccctagtgactgatgtgtcgtaccccgcttgacttacaccccgctacaggagggccactgctgacatcgcgttcacgaacgaatttccggacggagcattagagcaattatcttggagttgcagatctgtacctgaagattcatattgaaatctggaagcttctgctgttgagtacagaggaatatttcgtgcctttagaggaagactgcagagcccctaaatgtggaacatgtttcttttgcagtctacacctgaatgctgactaactcagcgtcttacgttacttagctgaaggtcggactggtacatacaccgcatgatggagcgagcatcgggtgtcaggggtccctgaacacaataattgatatttcaaggggagattggtccttcctggcttcggattctcctaccgtctggaagagaggaacgtgcacgaatcgaaatcctgttggaaaagggctctcataaacagcttttaaaacgtggcctag

SEQ ID NO: 89329 - DNA, 1110 bp, Zea mays
  misc_feature: Ceres CLONE 1576949
  misc_feature: Encodes the peptide sequence at SEQ ID NO. 89330
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (31)..(31): n is a, c, t, g, unknown, or other
  misc_feature (53)..(53): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (77)..(77): n is a, c, t, g, unknown, or other
aaaggtggggttnnagngtgggtgggggaanaaagataaaaaattttttgtgngggtgttcaacttcanccnncgtnacaaactggaactccccgcggtggcggccgcctctcgcgccgcgctcctcgacgactccaacgctccgtctggcgcctagcaacggtcggcgcgctggaaggtgcggtcggcctacggcgatattggcctccggtaccgcgaggacgagacagttgcctacgtcgcgtcacgcatgccatccatctacgccgcgtgccaccgcgtgctacgcgaggttagacgaaggttgccagagtttgcgcctgccaaggtgttggattttggcgccgggccaagttcagctctttgggcaatgagggcagtgtggccaaaatcaatagagagggttaacctggtcgagccttccaaggaaatgcaaagagcagggcagagtcttctcgacaatctgaaggggttgccacttattcacagccatgacagcatccaatagttgaaccgcaaaatagaaaaacatgatgcgaggccatgaatcgtgtagtaatcatccttatggcacttaggcgaagattcccttctttgaggtgaccggaatcaccaataagtagcggcccaggccttttggggaccctgcacgaagttggatggtttttggcgtattatggttaagaaggcgcttggggaaacatcccttcaaggggggagctcaaacagtattccacttaaacagtcccagcaattgggcccccccgcctatattataattatccctctttggggaatttggggaaagaaaaagagtaaacagttgggttccgcctcataaaatttttggaaaataaaagactccctctcaaaagccccgattccctttcccgaatgtttaaatccagtgggatcacgaaggtttattctcgggaaacaccaacaaaaacaataaggtccttctccacgttttgaaaaaaaaaatggggcggtctccttctatatggggttggggttgtagccgccccgatttggcgtcccttcgaaatggaaatgcggacaccgaaactggtctcccctctgttggcgagagaaaatttctccgcgaac

SEQ ID NO: 89330 - protein, 85 aa, Zea mays
  misc_feature: Ceres CLONE 1576949
MPSIYAACHRVLREVRRRLPEFAPAKVLDFGAGPSSALWAMRAVWPKSIERVNLVEPSKEMQRAGQSLLDNLKGLPLIHSHDSIQ

SEQ ID NO: 89331 - DNA, 844 bp, Zea mays
  misc_feature: Ceres CLONE 1576950
  misc_feature: Encodes the peptide sequence at SEQ ID NO. 89332
ggagctcaccgcggtggcggccgctctagaactagtggatcccccgggctgcaggaattcgtctcacccctagaaaaagtcaagtcatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcaaggcgagaagatcgagaagatgaagactgccatgaagttcgtggtgaagaagctcagctccatcgaccgcctctccatcgtcaccttcctggacaccgcccacaggatctgcccgctgcggcaggtgaaccgaggacctccacgccgcagctgctggaagctcatcgacccccctccaggcccggcggggaacacccaacattagcggacggccttcccaaaaggggggcccaagggccctccgcccgaaccgcaagccccagcctccggggccccggtccgttttgggggttaatgggtttatgtgttcccaaaggggcccaacaaaaaaaccggggggggcgagaccaagccccgccccaaaagttttaaagatatcaggggaaaaaccgtggcccgcgggggtgtaacacccactctttggggggggttttcgggggcggggagaaaaaataaatagaaaccccgcccgg

SEQ ID NO: 89332 - protein, 142 aa, Zea mays
  misc_feature: Ceres CLONE 1576950
MSFSDDEPIIPSPNSGPRPTPIVPGRVQLVSKNNNMAPLEENTQKVLLELTGGDSTSDRSGLDLVAVLDVSGSMQGEKIEKMKTAMKFVVKKLSSIDRLSIVTFLDTAHRICPLRQVNRGPPRRSCWKLIDPPPGPAGNTQH

SEQ ID NO: 89333 - DNA, 770 bp, Zea mays
  misc_feature: Ceres CLONE 1576954
  misc_feature: Translation starting site: 253
ggagctcaccgcggtggcggccgctctagaactagtggatcccccgggctgcaggaattcgtctcacccctagaaaaaatctcggcttcgcgtaatgttgcggacaccctcaaggggcagcgccggcggcggcggcgagagcgagctggagagcccgctgctgggcgcgtcgtcaacgggccacggcgaggcggtggcgagcgggcagctggagagcatcctgggcaacacgtccttgccgcgggggacacgatggcgtcggcgtccgcgacggagatgcggctgctggtgcgcctggccgcgcccgccgagctcgtggacatgaccgactacctcatgtccatgtccacgcagatcttgacgggacacctcggcacgctcgagcttgccgccgcctctctcggaagcgcgcgagcatccaggtcttctcctacggcctcatgctgggcatgtgcgacgcggtagacacactctgctggagggcttactgtgcgcacaaatacgacatgctgggcatctacctgcagagctcccccgtcctgccgatggccacggcggtgccgctggcggagctgttcacactgtcccgtcgcaatctgctcctgctggggggagtccccctcagatcacgtctgaccgacgaccgtctttccagtacgaggctggttcccgcttaataatcccccgtacgccccccaacattcccctatccaagaaggttactggcagagcttcaggatcttccggggtggggcccatggggcctaaaa

SEQ ID NO: 89334 - DNA, 831 bp, Zea mays
  misc_feature: Ceres CLONE 1576955
  misc_feature: Encodes the peptide sequence at SEQ ID NO. 89335
  misc_feature (831)..(831): n is a, c, t, g, unknown, or other
ctggagctccccgcggtggcggccgctctagaactagtggatcccccgggctgcaggaattcgtctcacccctagaaaaaaaaaagaggttccactctgtctgttccctccttcctgctgttacaatgattgttactattagccagtctgagtaatacatgtgcatttggtattgtccttgtttactagtagctaatagctgttaagatctaaaaccagccatccgtcttctgggaagaagaggtatagtctcccgatcctagttctgcctctccagttgcatccttcgtcactcactctccctacatcctgtcacgagactggtgttcagacctgagagacctttactcccatggttcagatgtctttgcagaggtccgtttctgtatgctacttcttggaatccagctttgtgtttactggtgcttagtgtctgtgatctagaatgccgcagcttttacacagtgattcaaaacctgttcttgcaggagcatagccgtatatcctcgttgctccttatctgattcgttccatcgtgtgggtggttcacgaagaagatgggcctcttgtaggtcccagtcatcacgttttgcttataatgcaagaccatccccaattgttctcaagaccgaccatgcaattgatccccctgaaccaaaggatttggatgcaagttcctcagcttcaagaagtggaccttacattgggacttgccatccatcaggcgcagtcggagtgatgggtgcgtcttcctcttcctgcctcagattttttagagaaatttgtgagttggaagcactgggagtggagaaagagcacctccgttcatcn

SEQ ID NO: 89335 - protein, 31 aa, Zea mays
  misc_feature: Ceres CLONE 1576955
MGASSSSCLRFFREICELEALGVEKEHLRSS

SEQ ID NO: 89336 - DNA, 910 bp, Zea mays
  misc_feature: Ceres CLONE 1576956
  misc_feature: Encodes the peptide sequence at SEQ ID NO. 89337
  misc_feature (720)..(720): n is a, c, t, g, unknown, or other
tccccgcggtggcggccgctctagaactagtggatcccccgggctgcaggaattcgtctcacccctagaaaaaaatcaccttcttcgtttcatcctctgattctccccctgctggtctgctctgctcccatcccatggagcccgacgccgcccaaaaccctagccccagccccgtccccccgcccatctccgcctactaccagacgcgcgccgaacaccacgccgtcgtaactagcgactggctcgcccacgccgccgccgcagccgcagccttccccggcgccgataccgccgatgccgccccgcccccgtcccccgggggcggcggcgtgatcgaggagttcaacttctggcgccgcaagcccgaggccgccgaggcggtggccgccatcatggctctcgccgccgtcatccgctccagcagggccaccaccatgatggagctcgagatcgagctcaagaaggcatctgacaagctcaagtcctgggatgctacatccatttctctttctgctgcttgtgatttgttcatgcggtttgtaacgaggacctcacatctggagcatgagaagtttgatgcagcaaaatcgcggctaattgagcgaggagaaaaatttggggagatatctttaaaagctcgcaagacaattgcaatgcttagtcaggatttttatttatgatggggtgtactatacttggtccatggggttattccagagntagttctggaaagtttctaaaggcttgcctgcatcccaaatcgcaggcttctttccgggggaacaatgtcccagggtgtacaaaggaattttaggtttgcaaagaaaggtgggaataattctggtttttccaaaccaaaagaattaggctttgtcccttgtgtgggccacaattaatgtttccaataccc

SEQ ID NO: 89337 - protein, 181 aa, Zea mays
  misc_feature: Ceres CLONE 1576956
MEPDAAQNPSPSPVPPPISAYYQTRAEHHAVVTSDWLAHAAAAAAAFPGADTADAAPPPSPGGGGVIEEFNFWRRKPEAAEAVAAIMALAAVIRSSRATTMMELEIELKKASDKLKSWDATSISLSAACDLFMRFVTRTSHLEHEKFDAAKSRLIERGEKFGEISLKARKTIAMLSQDFYL

SEQ ID NO: 89338 - DNA, 921 bp, Zea mays
  misc_feature: Ceres CLONE 1576957
  misc_feature: Encodes the peptide sequence at SEQ ID NO. 89339
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (733)..(733): n is a, c, t, g, unknown, or other
  misc_feature (736)..(736): n is a, c, t, g, unknown, or other
  misc_feature (737)..(737): n is a, c, t, g, unknown, or other
  misc_feature (740)..(740): n is a, c, t, g, unknown, or other
  misc_feature (741)..(741): n is a, c, t, g, unknown, or other
ctggagctccccgcggtggcggccgccctagagacatcggatcccccgggctgcgtgtattctcctcacccctacaagaactcggccaacctatcgtcctgggagccgaacatgacaacaccctgcatagcagcacctacggccgtggcatctctcctccgcatatcacctgcccatgcccgactggcgcctcgacatcctgagatccccccagctgcggcggcggccccctgagtgtacggaggtgagcagcaacacgacggtgggcaacctcggtcttctgcaacaggctgatgatgctccagctccacaggatggggcgagcgccggggatatctggagcctcgacgagctgctcatgctggcagcagctggtgcttattgagaaccgcaagaaaaaaaaatgtgttggcgctgctagctggagacgagacgagggcgagaggcagttgcatcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccataattatgtatgcactcctcctatataaactatattattannnnnnaannnnannannnnnnnnnnnnaanaannaannaaatattcattgccttggactgtacccagtttagcttccctcccctgccctatgctctagccaaattgcagctgggacgtgggagttcagtgcccatgctggtagtagctctctccccagcaccgtggcatttacccttgtctcaaagccaactccgggtttgggaccccaaaccaatcc

SEQ ID NO: 89339 - protein, 114 aa, Zea mays
  misc_feature: Ceres CLONE 1576957
MMLQLHRMGRAPGISGASTSCSCWQQLVLIENRKKKKCVGAASWRRDEGERQLHHPPSAIVLSLLYLVYICFWQSNSMAMRVYSVLLPSMIGSELETGSIIHLCLPSYRRPAGL

SEQ ID NO: 89340 - DNA, 675 bp, Zea mays
  misc_feature: Ceres CLONE 1576958
  misc_feature (178)..(178): n is a, c, t, g, unknown, or other
  misc_feature (241)..(241): n is a, c, t, g, unknown, or other
  misc_feature (278)..(278): n is a, c, t, g, unknown, or other
  misc_feature (279)..(279): n is a, c, t, g, unknown, or other
  misc_feature (318)..(318): n is a, c, t, g, unknown, or other
  misc_feature (319)..(319): n is a, c, t, g, unknown, or other
  misc_feature (333)..(333): n is a, c, t, g, unknown, or other
tggagctcaccgcggtggcggccgctctagaactagtggatcccccgggctgcaggaattcgtctcacccctagaaaaaagtcgtcccccccggccccgacccccctccgtttgccaacgactccgggctccactgtcgctcgctctcgctcccttccctcccacgcaatggtggccngatcgcctccgcctcgcgctgctgctctccgcgtgcctctgctccgcgtgggcgcgcccacgncctcgagccgaccatccgcctgccgtccgagcgcgcnnggcggccgacgaacgccgtcggggaccccgggtggggcnncgtgctcatcgccnggcttcccacgggctaactaaaaaccttacccggccaccccagggggggaaatcctgggccattggcttttccccgaaattcttttaaaaaaaaaaggggggcggcggaacctttttttttggggggggggggaaaaaaaacccccccccggggggggggcgccccccccccggtggggggcaaaaaaaaaaaaaaaaacacccccgcccaaaaaaaaaccccccccgcggagaaaaaaaaaaaatttcccccccccggggggccccccccgtcggggggggggggtcctcccccccccccccccaaaaaaaaaaaaaaaaaaaaaaaaaaaacacccccca

SEQ ID NO: 89341 - DNA, 1183 bp, Zea mays
  misc_feature: Ceres CLONE 1576959
  misc_feature (15)..(15): n is a, c, t, g, unknown, or other
  misc_feature (17)..(17): n is a, c, t, g, unknown, or other
  misc_feature (21)..(21): n is a, c, t, g, unknown, or other
  misc_feature (39)..(39): n is a, c, t, g, unknown, or other
ttttttttttttttntntgtnttttttgtgcggcggggncgggggggagggaaccatacacgcgtcggtagtatgtgagagagtattatagttggagctccccgcggtggcggccgctctagaatagtggatcccccgggctgcaggaattcgtctcacccctagaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcaactgacgaacacgcttcaacgccgtcgtcgttctcaccgctatcttgtcgtcgcctccgcgactagagcccaacaaggaggccgcccccgtgacagatcgaagaacttggaacctcaagctctccttccgggccgcgggccgaaccaccggggaagctccccccccccccgttgggcggggaagaccccacgggcagacaaacaaactgggggaagggggcttggcttggaaaccccccaataagaaaggggagggtggctccccctcccagagggaaaaccttccactccccgccttaaacggggggctaagagttttcctccccccccaaggggccccaaccccttataagagagaaagagggtcattttttcgtagaacatcttaaggaaaaaccacggcgcttgtttttttctcccccccccattaaaacaggagggggggggaaaaaaacagtgtctaacaaagttacaaccccgcgggggggggagagaaaaaaaacctctttttatttgccacaagaaagaaagagtcgggggagcccctctgagggggggggggttatatgggggctataaaaaaagaggtggttcactcccgccctcttaatccctcttataaaggcgcacaccctctggtgaaaacaagacacctctccagaggtatctcccccacacaatttttgtgggagggataaaaaaaaaaggggcggcccccaaagaggccaaacaaaatgttgggtaagacaaggagcccccg

SEQ ID NO: 89342 - DNA, 793 bp, Zea mays
  misc_feature: Ceres CLONE 1576960
ctcaccgcggtggcggccgctctagaactagtggatcccccgggctgcaggaattcgtctcacccctagaaaaaataggggccatcagatccaagaagagggaagagcaccaaggaccttcggcgcccgttcaggatccacatcttcccgagcgagttcttggttgacctcttcccccttcggaccacctccaagggtatgcacccccaccccttcttcccctttcccccttttcccctttactttctctcaggaaatctgtgattacttttttgtgtcctcgtaatttcgtcccggactagctgtttatgatccattctgtacttgttctcttagaaacccttttgttcagtgttattgttcaagattcattcctcgactacgatggtcctaggaaattaaaattagttgttttttctgagtatgtgctagccttctgagctaaatttgtatcgatcttgctttttttaatgataatcgctactctccccccatagtttgtagttatgtttgtttgtttttgttagataacgcttttcttgaattgcgtctggatcttattactatgtttgttgctctgaggctgttaagtaattgtaatcagactgggtgtagctgctggccctgaatcccaacagtcagcttgctcgggtttgagaggatttatgttgggtaattttggtcatggctgcacagaaaggattaatcttgatggaaaaaatttacaggaaatctttcatgagaataaaagcgtgtcatccttatgccccttgcttttgttgattctacaggc

SEQ ID NO: 89343 - DNA, 907 bp, Zea mays
  misc_feature: Ceres CLONE 1576961
cggccgctctagaactagtggatcccccgggctgtaggaattcgtctcacccctagaaaaatctcctctccctcgcgtccgcacatatcccgtgctccgccgtctgaaaaccctccccacctacggcggcggaggcggcgctggcgcaccaggtgtcttctccggccactctcccccctactaacaagacaaaatcgatgtaccagttgatgaccctgtgcagaacctcgctggaagtcctagtacccttggtaatgaggaataagccactacttatgctaatgatgaagatccgtcctaggaacaaccggacaagctttacgatgaacccaaacacccaatgcaagacgagttcggtaaccgatgatgtgtgagcccccccccatcaatatttgtgaggccagaacgaattggaccgagcctccccccacagagacactgctaggaaactggggtgaacccaccatgaaagctacagttccctgcattaacaagaaatgggccttggcgtggccctgaaaaagagttgtgtttccgtaatactgggtttccctaccaccaaaaggtggggttgcccggtcattggggacgcatagagtgggattttcattcccggagaaattgtttttagtgaaatcaaaaaaccccgcccttcaagggtttccttttagggacctcacccaccatttgcccaaaaaggacctggttccctgactggctttccctaaaggccctccaaagtgaaggcattttgctggtgcctcaaacccccaaacaaaatggttacaatcctggggttacccgaagaacacgccttggggctccttctcctgacacttgtgggcttaaacccttattaaatttgcgagaaaaaaccccgtcgaaaaaaccgccattttaggtgggg

SEQ ID NO: 89344 - DNA, 724 bp, Zea mays
  misc_feature: Ceres CLONE 1576962
  misc_feature: Encodes the peptide sequence at SEQ ID NO. 89345
ccccgcggtggcggccgctctagaactagtggatcccccgggctgcaggaattcgtctcacccctagaaaaaagtcgtcccccccgggcccgacccccctccgtttgccaacgactccgggctccactgtcgctcgctctcgctcccttccctccgacgcaatggtggccgatcgcctccgcctcgcgctgctgctctccgcgtgcctctgctccgcgagggcgcgcccacgcctcgagccgaccatccgcctgccgtccgagcgcgcggcggacgacgacgccgtcggggacccggtggggccgtgcttagtcgcccgggcttccaacggactcctaaagctaaccgtccacccatgcggaacctttggcccttggaaatcccgggaataacttaaagaagggggcggggaccttaaggggcaggagaaaaaagcgggcggccccccccagggtaaaggaaggaacctttcccccgggattagggcccgggggaaaaaaattcccaaagggccccttggggggggccaattcattaaaaaacccatttccccccaagggggtggggccaaaagggtttttatttgcttggggggggcgcccccaaaggggggttttcccccgaggcgcccgaaaaaaggtccccaaaaccccccagaaaaatttttttttttccgaagaaagaggtgggggatttggccccacacaaaaaaaaataggcggct

SEQ ID NO: 89345 - protein, 76 aa, Zea mays
  misc_feature: Ceres CLONE 1576962
MVADRLRLALLLSACLCSARARPRLEPTIRLPSERAADDDAVGDPVGPCLVARASNGLLKLTVHPCGTFGPWKSRE

SEQ ID NO: 89346 - DNA, 957 bp, Zea mays
  misc_feature: Ceres CLONE 1576964
  misc_feature: Encodes the peptide sequence at SEQ ID NO. 89347
  misc_feature (295)..(295): n is a, c, t, g, unknown, or other
  misc_feature (595)..(595): n is a, c, t, g, unknown, or other
  misc_feature (614)..(614): n is a, c, t, g, unknown, or other
  misc_feature (632)..(632): n is a, c, t, g, unknown, or other
  misc_feature (636)..(636): n is a, c, t, g, unknown, or other
  misc_feature (640)..(640): n is a, c, t, g, unknown, or other
  misc_feature (652)..(652): n is a, c, t, g, unknown, or other
  misc_feature (657)..(657): n is a, c, t, g, unknown, or other
  misc_feature (673)..(673): n is a, c, t, g, unknown, or other
  misc_feature (755)..(755): n is a, c, t, g, unknown, or other
  misc_feature (759)..(759): n is a, c, t, g, unknown, or other
  misc_feature (818)..(818): n is a, c, t, g, unknown, or other
  misc_feature (828)..(828): n is a, c, t, g, unknown, or other
  misc_feature (876)..(876): n is a, c, t, g, unknown, or other
  misc_feature (906)..(906): n is a, c, t, g, unknown, or other
  misc_feature (923)..(923): n is a, c, t, g, unknown, or other
ggacacggcaaaactgggactccccgcggtggcggccgctctagaactagtggatcccccgggctgcaggaattcgtctcacccctagaaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcngcagaggtccgtgggaggcgttccggtgcacgaactaccaaagaaagggcaatggggccggcctgggttttcgattggcccccccaaaaaaacttggaattggggggaaatttccccgcggctcccccaaaaaaagcaagggaggaagaaaaaaatacctcttttttgggggggaaaaaaaaaaagacgccccccctaaaagaacacccctttttttggggggggggggggacaaaaaaaagagaaggtgtccccctcccgctaatacaagcgccaccctatttattttatgctcgtgcnaacaagacaggggcgacgncctactataaggttgagntganaatnaagcgacgctcncaccnctatttcttttctgtntaaacaaacaaaagggcagcggcgtgggggacgcaccaaaaaacaaagaatatattctgtgttttcgtcccccaccccccgntcgncaaagaaaaaaagaaaggggggggaggagattaattcttacactcccggggaaggaganaggaagaggnaatccgtcttcgcccacggcgagagggacaaaaaaccgagacctccgntccgcccgccacaaaaaaaaaacaaagagnagcagaggggagcgagnacataataaaacagtaacggtccgggcggcgggg

SEQ ID NO: 89347 - protein, 157 aa, Zea mays
  misc_feature: Ceres CLONE 1576964
  misc_feature: SWISSPROT Homolog: EC 1.2.1.3 Aldehyde dehydrogenase (NAD(+))
  misc_feature (49)..(49): Xaa is any aa, unknown, or other
  misc_feature (149)..(149): Xaa is any aa, unknown, or other
  misc_feature (155)..(155): Xaa is any aa, unknown, or other
MGAFAKEEHQFLAELGLAQRNPGAFACGAWGGSGPTVTSTSPTNNQVIXRGPWEAFRCTNYQRKGNGAGLGFRLAPPKKLGIGGKFPRGSPKKSKGGRKKYLFFGGEKKKDAPPKRTPLFLGGGGDKKKRRCPPPANTSATLFILCSCXQDRGDXLL

SEQ ID NO: 89348 - DNA, 1276 bp, Zea mays
  misc_feature: Ceres CLONE 1576965
  misc_feature (15)..(15): n is a, c, t, g, unknown, or other
  misc_feature (19)..(19): n is a, c, t, g, unknown, or other
  misc_feature (21)..(21): n is a, c, t, g, unknown, or other
  misc_feature (23)..(23): n is a, c, t, g, unknown, or other
  misc_feature (1240)..(1240): n is a, c, t, g, unknown, or other
tttttttattttggntttnananccctattttgtgggggtagtcttgattgcaggcgaggcgcggagagaacgaaaaactgaactcccccggtggcggccgctctagactagtggatcccccgggctgcatgaattcgtctcacccctagaaaaaatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggttggccgtggccggccgtcgctgttctgttcctatttcttggcaactccgcccgtttcacctccggaggaccgacagcgacggcgccagtagatagatgcactactgacgccactggccacctcgagttcgagtgccaagggacgccacgagaccaaccgtgaggacagggacaacggtcgcccccccccccgcggatccgccggatttcgtccttccttggggtgccatgggatcccagtccgcccggcgaccggcgggaacattcggggggcccccgttgggaaaggtggggcggcccctgggtgggtccccgggagaaaggattcaagttcctttcggtgggggggcggaaggccaacgggcccagttcccgttcgccctacggagggttttcccccggccccggtacaccttttacggtggcccacacccctttgccaccacaatatcgcccgaaatattccccgttcccttttagaccaacttccccccgcgaaagatagatatgtcccaccctattttgtgcccccccgtatattttacgcgttttgtcccccactttgaagcgcaggggtgaccccacccctcctggggggagagggggggcgggcccccccccccctgggggggagaatggaaaatatgtggggcgtttggattgctcccataggtcgcatacccctttggagggaggcttctcccaccatgagtgggcaatcacaggggttgtggggagaagaccccctggtgggagaaaccccctctctctcggggggggagacaccttcccgcgggggagggggacgtctttagtgcgcctattatctctatctcgatgggggggacccccatatgtgggttttcgtgtgcagaccacctctccccgcaaggggggaaggtgcaccaccctttgggggggggggagagaaagaatgaattctgagtncggcctacacaaccccccccgcggggggtgtccccc

SEQ ID NO: 89349 - DNA, 945 bp, Zea mays
  misc_feature: Ceres CLONE 1576968
  misc_feature: Encodes the peptide sequence at SEQ ID NO. 89350
  misc_feature (856)..(856): n is a, c, t, g, unknown, or other
aaagctggagctccccgcggtggcggccgctctagaactagtggatcccccgggctgcaggaattcgtctcacccctagaaaaaccctatctttctcttatcttacgccgtcgtcgtcctgctccggcgacggccaggcagccgagcagataaaaagagccgaagcagcaccaccaccacgtgcctctcttctcagcttgcctgcctcactgcacccggccacaagggcaagatgcccgcctctgtcgctgtctacccggccaagatggcatgctgtctccagctccaccatcttcgccggccgtcccctgctccgctccctgctcgggtcctcttcctcctctcgaccccgcgcctgcgccccgtcagagcgtctcccggctcgtccccgcccaactccttcgctggctggtcctccgactccgacagcgcggatgacggcgccgacaaatctactctagggttcggccgagcaggagggcttcttggacctggacttgctgcctttttcttcctcgccggcattacctttgctgccgtctctatcagaagcagtggcacccacgcagctggaaaattgcaaaacttgcctacagagactgctgccacggaatcttaccctgattatcactcccacaaagaggatggtgctaccagggaagcttctttaccaacggattgggacgaagaagactatgacaacctcgataaaaaagaagatacagatgaattcctgacgcctctacagtcaaacgaggttcctggggggtgcagctgaagtgaagtggggcacctggtgcagaacactgagcctggtactgatggtgaccatgttgtcggtgaagaagcgatcagnttgacatctcattgcatcgatgggtatccagatccacaccaccttttgccatactcgatgctgcaaccccctcggaagaaatcctggaa

SEQ ID NO: 89350 - protein, 181 aa, Zea mays
  misc_feature: Ceres CLONE 1576968
MPASVAVYPAKMACCLQLHHLRRPSPAPLPARVLFLLSTPRLRPVRASPGSSPPNSFAGWSSDSDSADDGADKSTLGFGRAGGLLGPGLAAFFFLAGITFAAVSIRSSGTHAAGKLQNLPTETAATESYPDYHSHKEDGATREASLPTDWDEEDYDNLDKKEDTDEFLTPLQSNEVPGGCS

SEQ ID NO: 89351 - DNA, 777 bp, Zea mays
  misc_feature: Ceres CLONE 1576969
  misc_feature: Encodes the peptide sequence at SEQ ID NO. 89352
aaagctggagctccccgcggtggcggccgctctagaactagtggatcccccgggctgcaggaattcgtctcacccctagaaaaattcctccccaactcgccgtctgccttctgcgcctccatttcggcctctgtccctcgcaagttcaatctcacctccaaccatgggtaaagagaagtcccacatcaacattgtggttattggtcatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttggcgttcacccttgggagtgaaagcagatgaattttgctgctgcaacaagaatggatgccaaccacctcccaaatacctccaaaggcacctttattgaaaaaaaatttgggaaaaggaagatcttcaatcccctacctttcaaagaaaaagtttgggggtaccaaaccccctggattaaaaaaattgggcccttttg

SEQ ID NO: 89352 - protein, 145 aa, Zea mays
  misc_feature: Ceres CLONE 1576969
  misc_feature (5)..(146): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLGVHPWE

SEQ ID NO: 89353 - DNA, 865 bp, Zea mays
  misc_feature: Ceres CLONE 1576970
  misc_feature: Encodes the peptide sequence at SEQ ID NO. 89354
ggagctccccgcggtggcggccgctctagaactagtggatcccccgggctgcaggaattcgtctcacccctagaaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccggtccctgttggcagggctacccttgggacgcatcataaaatgttattggtgaaaccaattgatggagaagggtgaacataaaagaccaaacaaccttccttccctatttaaaccgtggaaacccccctgcccttttggttggaaccaaggccaccttgaaccaagcaaaatttcttgggttacctggggaattccaaggggttctgggggaatttttttctttggccacccccttacccaaaaagggggggg

SEQ ID NO: 89354 - protein, 167 aa, Zea mays
  misc_feature: Ceres CLONE 1576970
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITGPCWQGYPWDAS

SEQ ID NO: 89355 - DNA, 904 bp, Zea mays
  misc_feature: Ceres CLONE 1576972
  misc_feature: Encodes the peptide sequence at SEQ ID NO. 89356
aaagctggagctccccgcggtggcggccgctctagaactagtggatcccccgggctgcaggaattcgtctcacccctagaaaaaaaaaacacttacaatgaacatagatgttccagaaccatggcttgttgaaccagttattgccatccatgatttagacaacattcttttagagaatcttggcgatgtcagaactttgcaggcagtatttgaacttgaagctctcctcttgacaggtcattgcatggaaaaggaccgggaccctccccgtggtctgcagtttatccttggtactaaacaaagaccacacttagtagacacacttgtcatggccaacttgggttactggcagatgaaagtctcccctggtgtatggtacctacaactggctcctggccccaccccccatctgtatgagctacctccgaaactcattgccatttgatagcttgagaagcaaactaatgcatattgaagtgcaaaagaagaaaggcaaggagcatgaggacttgctaaatgctggcgatgaactaccacttccgggaaaagacggatacaaaggctggaataagaaccttttgaaatgggctttctagccttacacgggggaggccttcttaaaaagtaagctgaaaaaacccctgaccctaggggttccaaaaaagggggaaaccctaaaaaatttccccggtgctttcgggggcatctggatgaagcgtttcccccaaaaaaaggtttttggagggttctaaaaaaaaaaccaaaggccccgggagaattttgggtctttttaaaaaatttttttttccctcacagtttaagggggtttttacccccccattgtgttcggggaaaaataaaattccggagagaagccccccccccaaaataaaagaggggcaac

SEQ ID NO: 89356 - protein, 115 aa, Zea mays
  misc_feature: Ceres CLONE 1576972
  misc_feature (1)..(80): Pfam Name: UDP-g_GGTase Pfam Description: UDP-glucose:Glycoprotein Glucosyltransferase
MNIDVPEPWLVEPVIAIHDLDNILLENLGDVRTLQAVFELEALLLTGHCMEKDRDPPRGLQFILGTKQRPHLVDTLVMANLGYWQMKVSPGVWYLQLAPGPTPHLYELPPKLIAI

SEQ ID NO: 89357 - DNA, 737 bp, Zea mays
  misc_feature: Ceres CLONE 1576976
  misc_feature: Encodes the peptide sequence at SEQ ID NO. 89358
  misc_feature (530)..(530): n is a, c, t, g, unknown, or other
aaagctggagctcaccgcggtggcggccgctctagaactagtggatcccccgggctgcaggaattcgtctcacccctagaaaaaacctccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgnccgcatctgcgacggcatcctcgccctgctcgactcacacctcgtgccatccgccggcagcgccgagtccaagggcttcttacccggagcgtagggtgactaccacaggtacccttgctgagttcaagtctggtgcagagaggaaagatgctgcggagagcaccatgaatgcctacaaagctgctcagggacattgctcttgcagac

SEQ ID NO: 89358 - protein, 134 aa, Zea mays
  misc_feature: Ceres CLONE 1576976
  misc_feature (8)..(135): Pfam Name: 14-3-3 Pfam Description: 14-3-3 protein
  misc_feature (104)..(104): Xaa is any aa, unknown, or other
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELXRICDGILALLDSHLVPSAGSAESKGFLPGA

SEQ ID NO: 89359 - DNA, 990 bp, Zea mays
  misc_feature: Ceres CLONE 1576977
  misc_feature: Encodes the peptide sequence at SEQ ID NO. 89360
ccccgcggtggcggccgctctgtaaatgtcggatcccccgggctgctcgaatttctgtcacccctagagaaaggacccgcctccgcgtcctgggacacagccagccaccgctccttggcgtcgtccgacgaccagctgttcatgacgatgagccgcgagttcacggccatggtcgccgccggggcgaccatgcagcccggctgctacgtactgctcctccgagcagctcaccagcatctgcgaggactagctggaggagaccaacccgctggccatcgtccccgacagccaccccatcgcctcgcccgccaggtccagggcgtccgggctggaggtcgtgcccgcgggcccggaaccgcacccacccgcgcacctggaggccagccaggtcaagaaggaggaggcggagaccaaggtcacggcctggcagacggccgaggtcgcctatatctacaaccgcttcaagagggaggatgtggtcatcaacggctgggagaccgagcacgtggagaaagcctccgcgtggctcaagaagatcgagaggaagctggacgagcagcgcgccttggcgctggagaagtacgcataacgacatcgccaatgcgcggcgcaatgccgaggagaagcgggcgtctgcggaggccaagcggggccctcaaagcttggcccaaggtgctggagctccccaacttcatgaaagccgtcggcagggtgcccaccaagcggctccttcttatagccagccgaactacccttcaacctccgtctttcttccctgcctgacgagtgaatcgtagtacccctcgctggcagcttcccgataaccttaagtgtgataggaacaaatattggtgagcctgttatacggtacttgggcctggctggaatcccccaggggtatttcttgtccattccgctgctttaacaagagggtgtccagaagggcgccgccactccccattgtctcttattgcaccatgccctatttcg

SEQ ID NO: 89360 - protein, 260 aa, Zea mays
  misc_feature: Ceres CLONE 1576977
PRGGGRSVNVGSPGLLEFLSPLEKGPASASWDTASHRSLASSDDQLFMTMSREFTAMVAAGATMQPGCYVLLLRAAHQHLRGLAGGDQPAGHRPRQPPHRLARQVQGVRAGGRARGPGTAPTRAPGGQPGQEGGGGDQGHGLADGRGRLYLQPLQEGGCGHQRLGDRARGESLRVAQEDREEAGRAARLGAGEVRITTSPMRGAMPRRSGRLRRPSGALKAWPKVLELPNFMKAVGRVPTKRLLLIASRTTLQPPSFFPA

SEQ ID NO: 89361 - DNA, 872 bp, Zea mays
  misc_feature: Ceres CLONE 1576979
  misc_feature: Translation starting site: 186
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtcttccatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccaccaaagatgctggggtgattgctggcatcaatgtgctgcgtatcatcaatgagccaaccgctgctggttttggctatgggcttgacaagaaagccacccagcgtcggtggagaagaatgtcctccatctttgaacttgggggtggggacctttcgaagtccccctccttaccattgaggaagggttcttttgagggccagggc

SEQ ID NO: 89362 - DNA, 842 bp, Zea mays
  misc_feature: Ceres CLONE 1576983
  misc_feature: Encodes the peptide sequence at SEQ ID NO. 89363
  misc_feature (759)..(759): n is a, c, t, g, unknown, or other
ctggagctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgaccacctcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggaggaggacggcgtctatgacctggacaacgagttcaactgggacggccatgactcgcagtctgtggccgagtccatgctctacggccacatgagctacggccgtggaggtgaccctaatggcgcgccacaagcttttcagctcaaccccaatgttccacttctcaccaacgggcagatggtggatgancatcccacggagcagcacgcgctggtgccttcttcatggttggggggggggggaaaaaaagatacattccctttccttatgca

SEQ ID NO: 89363 - protein, 191 aa, Zea mays
  misc_feature: Ceres CLONE 1576983
  misc_feature: SWISSPROT Homolog: EC 2.4.1.12 Cellulose synthase (UDP-forming)
  misc_feature (164)..(164): Xaa is any aa, unknown, or other
MEASAGLVAGSHNRNELVVIRRDGDPGPKPPREQNGQVCQICGDHLGLAPGGDPFVACNECAFPVCRDCYEYERREGTQNCPQCKTRYKRLKGCQRVTGDEEEDGVYDLDNEFNWDGHDSQSVAESMLYGHMSYGRGGDPNGAPQAFQLNPNVPLLTNGQMVDXHPTEQHALVPSSWLGGGGKKDTFPFLM

SEQ ID NO: 89364 - DNA, 796 bp, Zea mays
  misc_feature: Ceres CLONE 1576989
  misc_feature: Encodes the peptide sequence at SEQ ID NO. 89365
ctccccgcggtggcggccgctctagaactagtggatcccccgggctgcaggaattcgtctcacccctagaaaaaacggcctcacccagtcctcgactagccgacgccgagaagcccctcgatggcgaggcgaaggcgcgcagcaatcctgcctcgcttccctccaaattcccaaagctctcgcgcgcggtgccatggcggagcgcctcgccgcctccctcctccctgccgcctcgccgtccccgtccgcccgccgcgcaacggtcgcagccgcagccgccgcctctttcccctccccatgctccgcccgcgcggggctgcgcctacgctcccgcccgcccctcttctcgcagaaggcggccgggcgcgggtgtggcctgcgggtggtgcggtgcatggcagcgtcggacgcggcgcagctcaaggccgcgcgggaggacatcaaggaactccttaagagcacatactgccaccccatcatggtacacaacaacatactgtcctcctccctttcgagtctcgaggagctacccgttggaggaagccgtagaaggatttgtctgcctttgttctacatagtgacttgctatccaaatcagtgtttcagtgatactatatgtttatatgacattgtgcttgtttcccttgcattttactgggctgatcagtggaaattagtccgtgtaccattgcgctgggttgtttagtcactatatgtaccaaccagtgcctctgcagttataggcagaaaccagtttaccaggtccctgtagccattttggggttggggccaaaag

SEQ ID NO: 89365 - protein, 170 aa, Zea mays
  misc_feature: Ceres CLONE 1576989
  misc_feature: SWISSPROT Homolog: EC 1.11.1.11 L-ascorbate peroxidase
MAERLAASLLPAASPSPSARRATVAAAAAASFPSPCSARAGLRLRSRPPLFSQKAAGRGCGLRVVRCMAASDAAQLKAAREDIKELLKSTYCHPIMVHNNILSSSLSSLEELPVGGSRRRICLPLFYIVTCYPNQCFSDTICLYDIVLVSLAFYWADQWKLVRVPLRWVV

SEQ ID NO: 89366 - DNA, 874 bp, Zea mays
  misc_feature: Ceres CLONE 1576991
  misc_feature: Encodes the peptide sequence at SEQ ID NO. 89367
  misc_feature (764)..(764): n is a, c, t, g, unknown, or other
aaagctggagctccccgcggtggcggccgctctagaactagtggatcccccgggctgcaggaattcgtctcacccctagaaaaaagaaaaaacaagcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctcccntgagggattggctaaagaccaatgccagccctgaggttgctgaatctactaggatcatctacggaggctctgtaactgctgcgaactgcaagagctagcagcacagcctg

SEQ ID NO: 89367 - protein, 199 aa, Zea mays
  misc_feature: Ceres CLONE 1576991
  misc_feature (5)..(197): Pfam Name: TIM Pfam Description: Triosephosphate isomerase
  misc_feature: SWISSPROT Homolog: EC 5.3.1.1 Triose-phosphate isomerase
  misc_feature (189)..(189): Xaa is any aa, unknown, or other
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASXEGLAKDQCQP

SEQ ID NO: 89368 - DNA, 828 bp, Zea mays
  misc_feature: Ceres CLONE 1576995
  misc_feature: Encodes the peptide sequence at SEQ ID NO. 89369
ctccccgcggtggcggccgctctagaactagtggatcccccgggctgcaggaattcgtctcacccctagaaaaactattcgccgcgcccgcgcccgcgccgtctcgaggtccgccggtctccttccgccgcaagctttgctccattccaccgccgcctcttccgcctccgtcggcaaaatgccggtctacagcatccgcggcgtcaacgtcgacttccccttcgacgcctacgactgccagatcacctacatggaccgcgtcatcgagtccctgcaacaggggaagaacgcgctgctggagagtcctacgggtacggggaagacactgtgcctgctgtgtgcgtcgctcgcgtggcgccgcactttcggcgagttcctgcgggtcgggcatgggggcggtgggactaagcagttgccctacgggagtcagccgtccgctagccagcagtcagaggactctacgtctcagaagcagcagcagtcgcggtacccagtcatcatctacgcctcacggacccacagccagcttcggcaggttatcaaggagctcaaggctaccagctacaggccgaagatggcagtgctaggttcccgtgagcagatgtgcatccacgacgaagtgagcaaactccatggaagagcacagaacaatgcctgtcacttcctctgcaagaaacgacggtgccctcataataaccatgttgctgaagtcataaaaaacaaacctgaagctggggaatgaagccttttgatatagaagattttgataataatggggaggcattaaggccccgtgcccattatacatcttcccgggaaactttcaaa

SEQ ID NO: 89369 - protein, 187 aa, Zea mays
  misc_feature: Ceres CLONE 1576995
  misc_feature (109)..(188): Pfam Name: DEAD_2 Pfam Description: DEAD_2
MPVYSIRGVNVDFPFDAYDCQITYMDRVIESLQQGKNALLESPTGTGKTLCLLCASLAWRRTFGEFLRVGHGGGGTKQLPYGSQPSASQQSEDSTSQKQQQSRYPVIIYASRTHSQLRQVIKELKATSYRPKMAVLGSREQMCIHDEVSKLHGRAQNNACHFLCKKRRCPHNNHVAEVIKNKPEAGE

SEQ ID NO: 89370 - DNA, 799 bp, Zea mays
  misc_feature: Ceres CLONE 1576999
  misc_feature: Encodes the peptide sequence at SEQ ID NO. 89371
  misc_feature (663)..(663): n is a, c, t, g, unknown, or other
ctggagctccccgcggtggcggccgctctagaactagtggatcccccgggctgcaggaattcgtctcacccctagaaaaatcattactgattacatctcatcgcctgaagtgaacttcctcaccagtatatctggaagagttagcaagaagacaaagcttgtgttccgctttcttgacgaaggctctattgagccatcgacaaaccagacatatgggtccatgttgaaaaatctaacatttgtcaagacttttgcctctggaatacttgttcccaaaagctatatctggcctgttacaccagataattaccttctgccttatacttcagttgttgatgatgcccacaaagcggggctagaaatctatgctgctgattttgcaaatgactttactatcagctataactacagctttgatccattagtggaatatctttccttcattggtaacagtgccttctctgtcgatggtgtgttgactgatttccctattactccttcagaggcagttggttgctttagtaacctgaacaacagcaagatcgaccatgctaaacctctgggtatctctcataatggtgctagcggtgactacccagactgcaccgaccaagcttatgaaaaggcagttgccgatggtgcagatgtcattgactgtcctgntcaagtgaccaaagatggcatactgatatgcatgaattctgttggacctaatggatgtccctactggtggaaaatcctcatttacttcccaaggtactaccttccacaatccgaagggtgggccctgggacccttc

SEQ ID NO: 89371 - protein, 193 aa, Zea mays
  misc_feature: Ceres CLONE 1576999
  misc_feature: SWISSPROT Homolog: EC 3.1.4.46 Glycerophosphodiester phosphodiesterase
  misc_feature (148)..(148): Xaa is any aa, unknown, or other
MLKNLTFVKTFASGILVPKSYIWPVTPDNYLLPYTSVVDDAHKAGLEIYAADFANDFTISYNYSFDPLVEYLSFIGNSAFSVDGVLTDFPITPSEAVGCFSNLNNSKIDHAKPLGISHNGASGDYPDCTDQAYEKAVADGADVIDCPXQVTKDGILICMNSVGPNGCPYWWKILIYFPRYYLPQSEGWALGPF

SEQ ID NO: 89372 - DNA, 1020 bp, Zea mays
  misc_feature: Ceres CLONE 1577001
  misc_feature: Encodes the peptide sequence at SEQ ID NO. 89373
  misc_feature (859)..(859): n is a, c, t, g, unknown, or other
tccccgcggtggcggccgctctagaactagtggatcccccgggctgcaggaattcgtctcacccctagaaaaaatctcctcgcagcctcggggacgcggcgaaaccatccagggcacaccgagctgtcgtttcgcggaccaatcgccccgctagggtttctctcccgggctcccgagctctccctccccgtctcctctcgccctcgagctctctgtcccctgtctcctcacgccctcgagctctcccaccccggctcctatcgccctcggagctctcactaccccgtctcttgtcgccctcgagctctcgcaccctccactcccgtcgctggtgaggatctggatactacagggtgcgtcaaaagcttaagttaaaatcaaataaggcccccccccgacggataattgcaggcctaccccaaaagggaaataacctaacccccttggcggggaggcccaacagcttctctcccatttctcttctgcaggggaaatttggttttaccgatttgcaaattgccgggggaaaaaaaccttaaagaacacgtttcacttggaagttagaaaaccgcccatttggctggtaatcccgaagaccgggctttttttcctacaaaaatttttttcaggatttgggaaaaggtgcgcgggccggaaaaaaaaagaccttttgtgggtgttataaacacctatagttgagaccctttttaaaaacttctcgcgtatattttttattaggggcaaaaaaaaaataccctccctttaaaaacaggggggcagagagaactgggccttgtaaaggacatcacactttttttttgagagtaaaacattttccaccttccccggggagaataanaaaatatttttttgaaacaagaggggtggaaaaattatgggctctaaagagggggcttctgggtaatataaaatttttttttgtgcgcaaacacttcgcgtcggtaatattggtcctcttaaacccccaggggggttttgttaagggggtgaataataaga

SEQ ID NO: 89373 - protein, 50 aa, Zea mays
  misc_feature: Ceres CLONE 1577001
PRGGGRSRTSGSPGLQEFVSPLEKISSQPRGRGETIQGTPSCRFADQSPR

SEQ ID NO: 89374 - DNA, 907 bp, Zea mays
  misc_feature: Ceres CLONE 1577004
  misc_feature: Encodes the peptide sequence at SEQ ID NO. 89375
  misc_feature (705)..(705): n is a, c, t, g, unknown, or other
ggagctccccgcggtggcggccgctctagaactagtggatcccccgggctgcaggaattcgtctcacccctagaaaaacgccatggacgcctgggaggccaccaaggcggtgttcgaccgggtgcgggcactggacccggacaacgcgtccaagatcatgggcctgctactcatccaggacaacagcgacaaggagctcatccgcctcgccttcggccccgaccacctcctccacgccttcgtctccgccgcgcgcgccgacctcgccgccaagcccgcgtccccgccgtcgcccgtgctgggcccgctccaccagacctggggagcgccgactcacccgagccctaccgccggctccgaccacccacaccaggcccccttcgccgccgacctcgcgctcggctacgacttcgacggcgccggcgccggcgctgacgcgttcttccccgacgactacgactgctggtcaccggccggcgccgcccaccgccgcagcttctcgctcagtgacgccgaggccgccgccgccaccggaggcgtcgcgtggaggccatgcatgtacttcgcgcgcgggttctgcaagaactgctcctcctgccgcttcctccacggctttccggatgacgatgacgccgctgcggatcgctagatggtcgtcatgctcgccatagcccttgcccccggccgccgcggggcgaccccaanagaagcaggaggtcatggcgtccgccttttccttcctcgccggcgccggcctagggcgtgaaacctaaacttcctgttccccccgcataacaaggccccaagggggggggggggatggagccctgctgccccaagggggggaacaacctgccctggcgggttcccggggccggacccccctgtagggacaccggggaatttt

SEQ ID NO: 89375 - protein, 188 aa, Zea mays
  misc_feature: Ceres CLONE 1577004
MDAWEATKAVFDRVRALDPDNASKIMGLLLIQDNSDKELIRLAFGPDHLLHAFVSAARADLAAKPASPPSPVLGPLHQTWGAPTHPSPTAGSDHPHQAPFAADLALGYDFDGAGAGADAFFPDDYDCWSPAGAAHRRSFSLSDAEAAAATGGVAWRPCMYFARGFCKNCSSCRFLHGFPDDDDAAADR

SEQ ID NO: 89376 - DNA, 888 bp, Zea mays
  misc_feature: Ceres CLONE 1577005
  misc_feature: Encodes the peptide sequence at SEQ ID NO. 89377
  misc_feature (862)..(862): n is a, c, t, g, unknown, or other
ctggagctcaccgcggtggcggccgctctagaactagtggatcccccgggctgcaggaattcgtctcacccctagaaaaagttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacagggaattctgatgtggagggaggagaccaggattctgacggagacacgcgggcgaagagagcaatccagtctacctgcgctgcaggtgatgtggtcattgatcccagntatggggagccccctctgactcacct

SEQ ID NO: 89377 - protein, 200 aa, Zea mays
  misc_feature: Ceres CLONE 1577005
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNLQVSHPTKEAPVIDYKLALLFQPMLMLGITIGVELSVIFPYWLITVLIIILFVGTSSRSFYREF

SEQ ID NO: 89378 - DNA, 805 bp, Zea mays
  misc_feature: Ceres CLONE 1577006
ccgcggtggcggccgctctagaactagtggatcccccgggctgcaggaattcgtctcacccctagaaaaaagatgagcctctggatcgccggcacaggcgcgatgctcgccgcctccgcctcgtccggtcagatggccggcctctgcgtcccgcgccgctcgcccactcctccgctcctcgcccgccgcggccgcggccgattgcttcctcgtcgcccggccacgctactccgccgcgacctccgccccgccgccgccgcgtctccgccgcccccgtccgccggctccgcgctagaacatcgagtacgtaaaaagtgctcaccactactggagagtgctctgctgcctggtgaaagtgattcgactctgcatgaatggaaggctgttccagatatttggaggacagccgcagaaaaatatgctgacctcgtagctgtggtagatccttaccatgaaccgccaacggaatggacgtatacacagcttgagcaagaaatattggatttttctcaaggtctaagggccattggcgttgctccggatgaaaaactagcactttttgctgataactcatgtcgttggctagttgcagatcaaagaatcatggcaaccggtgctatcaatgttgttaggggaacaagatcatctgatgaagatttgtttcaaatatacactcattcagaaagcattgcacttggtgggggacagccctcatttctttaaccgggcttggagagtctttcatggtcaaggattaatacaaagaatcattggttccctccttggggggggacaaatcaatgca

SEQ ID NO: 89379 - DNA, 827 bp, Zea mays
  misc_feature: Ceres CLONE 1577007
  misc_feature: Encodes the peptide sequence at SEQ ID NO. 89380
tacccgcggtggcggccgctctagaactagtggatcccccgggctgcaggaattcgtctcacccctagaaaaagaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtggcgaagctactgcccgctcgtcatctccatcccccatcgggcctcgcccgtgaggtttcctcgcgccgcggcccgtcaagggttagcccgcagggcgtggcaggctcctctcccaatcttccttctccacaatccccgggggctgggggctttggcccctcctccccgtcgggcgcatggggcctttcctcggggctcacaggccggcggttggccaattgaaagagctccccttttaaacggcccggcttttttcgcccccttaaccaaaaaaaggggccatctgggggcccaaacccccaaattttccccttttttttcttttcgccggggcgcgggggtttctcttaaaaaaaaagagggggccctctgttggggaaaacaaaataatcgcccccacccccataattttttttataaaaaaaaaagggggccctctccggagggagagcacgcaccca

SEQ ID NO: 89380 - protein, 101 aa, Zea mays
  misc_feature: Ceres CLONE 1577007
MELHLATIAHRPPLPVPARGHHLRRRLHHLPAPLSFQNTYSPSLSSPHHHRLSPTLRRHLRLPLLASQAPNSNPEPEPEPEPTGGEATARSSSPSPIGPRP

SEQ ID NO: 89381 - DNA, 892 bp, Zea mays
  misc_feature: Ceres CLONE 1577008
  misc_feature: Encodes the peptide sequence at SEQ ID NO. 89382
ctccccgcggtggcggccgctctagaactagtggatcccccgggctgcaggaattcgtctcacccctagaaaaagcaaaaatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcagggggaggccccgcgccgccatgtacgggctcatccccgaagacttcggggcctacgcggggcccttgggtccgcaaacttcccgcccccgttgaatgcctcaaggggcccccacctggccccgatggaccgttccccaaaaaggaaaattccccgggtttttcccgcgcggggggggcccaggggtaaaggggggctaaagcccaaaaaaggggccccgggttttaaaagggaagcccctcccccccttttcccccccccggggaatatctgggaaaaatttttttcccggggaaaaatgttaattttccccaaaaaagagggggaaaggggctcctaaaaaaccccccccaaaaatttttttttgtgggggacccttaattctctctgggaaaaaaaaaatagggggagcccccccccttgttggtcctttttgagagaaaaataa

SEQ ID NO: 89382 - protein, 117 aa, Zea mays
  misc_feature: Ceres CLONE 1577008
MGGEVPEPRRLSRSLSFGCGGVPEEALHLVLGYVDDPRDREAASLVCRRWHRIDALSRKHVTVGFCYAVEPARLLARFRRLESLALRGRPRAAMYGLIPEDFGAYAGPLGPQTSRPR

SEQ ID NO: 89383 - DNA, 1333 bp, Zea mays
  misc_feature: Ceres CLONE 1577011
  misc_feature: Encodes the peptide sequence at SEQ ID NO. 89384
  misc_feature (748)..(748): n is a, c, t, g, unknown, or other
  misc_feature (1101)..(1101): n is a, c, t, g, unknown, or other
tttttggtttttggggggttttcaagttgtgtcttgtctgcgtgtggggggtgttcctcttattaacccccccagcagagagctggagctccccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgagggagggagcgccacacgcagcagatgcaattccatcaggtgcgtgcgttgggcgtcctctgaacccgttgaaaaccggggcccgaataggtggggtcaaagggggcgaacccccgggccgggccaaagtgggaggaaggcccccccccccccaaggggcggccgccccttcagtaacgccccggaaagggggggcccaccccgggccaatggaaaaccgggacccaaaccccccccgtcctgtgtccccacccccgagtaccaaaatttcgcnccgccgtgtccaaaggcacggtgaaacacagaggccatctctcccccttattcaaatagaagattgttctaaaacacacttttctcatatgtgttgggggggagggcccccgctgccaccaaaataccgcccctaaaaacctccctctgtttatgtttttctgatagaggcgccccttgtgtggggccgccggtgaaaaaagacaacattgggggaatcaaatccccaacaaaacagacgacccaatatgggggggccccacactttgtttaccagcaaccgtgcgtacccacccctaaaaataaactaaaagagggggggtcaggcgtgaactctgtatttataacgcgcanatcaatcaaactaggatatttaccaactcactcgattacgagagattgcatctcaccattttgtggacgcgggaaaaacgacagctcgtattcagttgtggggggtggagcgcacacaacaacatagaagcccgagagggccgcgggggatccctccctcccccccgttgggggtgaacacaaatagaatgacacgcatatccttttacttatagaggagaaggagacagag

SEQ ID NO: 89384 - protein, 173 aa, Zea mays
  misc_feature: Ceres CLONE 1577011
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISEGGSATRSRCNSIRCVRWASSEPVENRGPNRWGQRGRTPGPGQSGRKAPPPPRGGRPFSNAPERGGPPRANGKPGPKPPPSCVPTPEYQNFAPPCPKAR

SEQ ID NO: 89385 - DNA, 872 bp, Zea mays
  misc_feature: Ceres CLONE 1577012
  misc_feature: Encodes the peptide sequence at SEQ ID NO. 89386
ggagctccccgcggtggcggccgctctagaactagtggatcccccgggctgcaggaattcgtctcacccctagaaaaagcgccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaaccagatcccgtggcgtggggactcggcgttgaccgacgggaaggaagcggggctggatctttccaagggaatgtatgatgctggggatcacatgaagttcaccttcccgatggcattcacggcgaacggagctcacgtggtcgggtgctgggagtacgggggatcagaaggagcgccgggcaagcaaactgggaccctgcccctcggagggcactgaaagtgggatttacagaattttcccttaatttggcctggcacatacccttccaggacaaaaggggggctgggaataattccccagggtcggggggggaatccttgggaatttgtggggacccccccaatt

SEQ ID NO: 89386 - protein, 149 aa, Zea mays
  misc_feature: Ceres CLONE 1577012
  misc_feature: SWISSPROT Homolog: EC 3.2.1.4 Cellulase
MGSKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTANGAHVVGCWEYGGSEGAPGKQTGTLPLGGH

SEQ ID NO: 89387 - DNA, 945 bp, Zea mays
  misc_feature: Ceres CLONE 1577019
  misc_feature: Encodes the peptide sequence at SEQ ID NO. 89388
tggagctccccgcggtggcggccgctctggaactagtggatcccccgggctgcaggaattcgtctcacccctagaaaaaattgcatcgcccaaccaaacaagtttagatatgagaatatagcatcgcccgcgctctggagagtctggatcctcctgaacctgcaagcagcaaacgatgaaaggagggacgcaagacagttaccctgatggtgcaccttgctgtgccatggctgcagccttgcttcttgggcaggtctgctaccagcgctagcaactggaaatgtgggtgcagcagctccgatactgagagcagattacttgaaattgaacttcagcaccgctgcggcgactcccgacaagtacaagagcttcatcgcttctgttcgaggaggctagcccacgaaagagtgaggaagcgttcgcaggatacacgtgctgggcgatgaacactatgccactcaggctggaatcgggtctaaccttcaaaaaggtcaaataaggccgggcgctcccgaagattgaaagatggacgttctccgaaggcctacttcggggggtaaccttacaaggggcctcctcctcggccctccctcaaaggaatagggaccgggctgtttcctttcggggagaatcgttaaaccccggggggcccctggggggaaaaaagtgtgggatctcggttaaaaaaaaacattttttttttttcccccccaaagggccagggaatttttgggggcccgcggatgggccactccaaaaaaactttggaaaaaaacaaaatttttccccctttactttttgccccgggggcaacggccccccaaaaaaaacacttaaaaacgggggtgtccccccccctacaaaattatgtgggggagatggggggggggtcctccgcaaaggagtaggggggaaagaaaaccccctcttttggtggcacacaag

SEQ ID NO: 89388 - protein, 31 aa, Zea mays
  misc_feature: Ceres CLONE 1577019
MKGGTQDSYPDGAPCCAMAAALLLGQVCYQR

SEQ ID NO: 89389 - DNA, 1257 bp, Zea mays
  misc_feature: Ceres CLONE 1577020
  misc_feature (1257)..(1257): n is a, c, t, g, unknown, or other
ttatcgcattacaaaaccacccttctctcattttataccacctcatactctccactccagctctctgtttctgtgacttgatcttcccgcggtggcggccgctctagaactagtggatcccccgggctgcaggaattcgtctcacccctagaaaaaggttggttggggtggaggaccgtcgccttccccgtttcgtcttccggtcctcgttttatcccctcgcccttgcactcctccgccgcacccctttcctccttccgccctccgccgcgcctggctttctcccttcccgagaggccacgctccatccccgcccgcgctgcctcccctggcgatcggcggcgaccgcggcccaacgaaagcgtcgtggtcggccgctgtcacgcttcttgcagacgctgggcggactgggaacaagcgccaatgttgatcgccgtggtggctctacactccatgcccgtgggccgttcaccaaccctttccccggcattccacttctgtccccttcgagccggacttttatcaatgaataaaaaaggccgcatactatttctagtgcccacaccgccccaggaacacctccatagggtcttaccaaaaagggaatcaccaataggcttttaatgtatgggttatagagtgcgccttttccccctacttgtattttgtaattatactcgggtgtttacaagtcatggggcgaaaccagggccccctttggggacttctttagtgaattgttccctattaatatttaaaacgtctctttagcttcacctattttatttcttgttgggacatgtgagtctttttgtcctcctcccgacccatcccgtggacacagcctagctctctgcatcaacacacgatggccaataatgttgtgtggttattcctcacagtaatggcgtcgaagttgctatcagtgctctgtgtaaaagcacctcctcctccatttcgaaaagaggtcaggtgacaaagagtcatccgtcagttctcgatgtgttgtgtaggggtccctgaagagccgcctttgagttgtaatagcctatctactcgctcgtgggaggttctagtgctgcctgcgctttcctcacacttactggaatgtgtaagttattcctctggcgcagccgccactagtcaaatgtctcggctctttccctatccataacaccaatacatgttacagacttcgcatctctctatgggcggtatggtctgatcacctagctcctgactctattataattgttn

SEQ ID NO: 89390 - DNA, 1070 bp, Zea mays
  misc_feature: Ceres CLONE 1577021
ctccccgcggtggcggccgctctagaactaatggatcccccgggctgcgcgaattcgtctcacccctagaaaaaagtgtgcagcgcgagaacgtaggactgatagagcacgggtcccgtcgacgtcccacttcatcactatcacgctgaacgctgccattaaactgagtgcttgcagctcatccgtgctggcgagctccactcataaatgcgtgcgtatctgtgtgcatcattgctaccggcccggaagggctggacacgattgcgcatctgcgcatcagcctccagttcccggtgactacgcccactagtctctactaaataggcagagccggagctgctgctgccgacaccgatagaggctacgcctcccctgttctcgcgaagatccaacccccttcacccgccacccgcatggctcccgcgtccgagacgggactgcaagcaccaccaccggcggcggcttagggagatcaagtcgcccggaggggctgcctggaacccagtttcgctggtcaccgctgcaaacgcaagaaaacttgggtggcccactttcagggaagaacaaaccaacggcccctgtcttttcaccgcccagggaaacccttcttcggccgccccccttaaataaaacgtacccttccgggccggcttcccggtggggtggaggggggggcaccccacccccggggttataatatatccgccggggggagaagccccccttccccaggagaaacgtggttaaagaaacaccctgtgtggactgggtttggccccctcctttctctccacttttttgggagaatcaaaaagggggcgagagacccccggggcaaaaattatcgggtgtcccctcccgtataaaaggcggcctttcttgatgttcaagaggagaaagatacccccggtgtttcttaaccttccaaaaaccaccctaatatatcccccggggggacctccccgagtgctcccagagtgggggagtggtttctccccaccactttgggggagctttgagaaaaaccgtgtatccacaccctccgaacaggggttgtgcccccaggagaa

SEQ ID NO: 89391 - DNA, 1168 bp, Zea mays
  misc_feature: Ceres CLONE 1577022
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (54)..(54): n is a, c, t, g, unknown, or other
gtttttgggtgnnnnnnnncgggatgtgnnttgtgggggggagaggaggggagnaaaatattaatgcccgggggggggaaagctgggactccccgcggtggcggccgctctagactagtggatcccccgggctgctggaattggtctcacccctagaaaaagctagaaagcaatcgcccgcggtattatccatcaaggaagctgcatctgcttctcacgacgtctcgccttcctcttctcacccctcgccgtccgtctgcctcagcgcttgtacgcttgcctcaaaacccctggcgccgtgctaaaaccacagccctcgaattccttcccctgcccgcgcggagcagacgagcctgagcccgtcctcctcgtccatggcgtcctcagaggaccgccgcgtacctctgggtactgcttgggctcagcatcgcgagcgttctcctgtcagggcggctactgacgactcctgcgcgtcccggtcacggcgccttcagtcacccggctcctagactccctcccggccggccccaggccttccgccagacgcaggaggcccccagcccgcttcaaacgggaactcctggcctttccgccgatcgggctgaacaacaattggcaattgctctaagtgggggcatataattttatcaaagagttcttccggggcaaaaaatcatttggacaaatgggcgtgcccaaaagggaaccgcacctcccgcagacgtggccccagggaaaaaaggtgatgaccaacacaacacctagatccgttattgccacgtgttatcggggggtatatgtgggctaaaaagcccatcccgggggaggggctaatgggaataattaggcgcacgcgaggggtgcgcattttaaatctacggggcgcgaggagaagaggggggggggaagacaaaacaccccgggatggggtacgccacacaatgcggagggagaggttgggggggaatctataacagaggaattgatccccactaggggggccctgatgggtggatattaaaaagaaatagaatgttcattgaatattcacaagcccctggcggcagagaaagatgccggcggcggagggtgtactgagagaggagccgcggagagagtacaacgggatgagagggtaccatttttcccaacgggtgaggccttaagg

SEQ ID NO: 89392 - DNA, 869 bp, Zea mays
  misc_feature: Ceres CLONE 1577024
  misc_feature: Encodes the peptide sequence at SEQ ID NO. 89393
  misc_feature (425)..(425): n is a, c, t, g, unknown, or other
  misc_feature (443)..(443): n is a, c, t, g, unknown, or other
  misc_feature (460)..(460): n is a, c, t, g, unknown, or other
  misc_feature (462)..(462): n is a, c, t, g, unknown, or other
ctccccgcggtggcggccgctctagaactagtggatcccccgggctgcaggaattcgtctcacccctagaaaaagcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccatacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctgggtcagtacattgacagcnactttgaaggcccatcgntgctcccagaagatccntncaaaaagcagttcgctgaagagctgcttgcatatacggatgcatttaacaagcattataccttttgaaaagtctcccaggaaaaattgtcctaaaggaactttccctgcttttgaaaaaaaaaaaaaccccttgggaaatttcaagaagggcccttcccccctgggacagttaaaccggggggaaatttgggtttttcccattccccgggaggggttccaaaatttttttctccccacaaaaaacttttatttttttaggggggggaacccccccttttaaaaattttttttggggggaaggtgggaaaaaatttgtgtttttcccccccacattaaaaagggggcccccgtgtttttttttttttgggacaacaaaaaaaagcggggtggggggggggtcttcaag

SEQ ID NO: 89393 - protein, 139 aa, Zea mays
  misc_feature: Ceres CLONE 1577024
  misc_feature: SWISSPROT Homolog: EC 2.5.1.18 Glutathione transferase
  misc_feature (106)..(106): Xaa is any aa, unknown, or other
  misc_feature (112)..(112): Xaa is any aa, unknown, or other
  misc_feature (118)..(118): Xaa is any aa, unknown, or other
MAAAAPASSVKEVLPSPLTSASEPPPLFDGTTRLYVAYHCPYAQRAWIARNYKGLQDKIKIVAIDLADRPTWYKEKVYPENKVPSLEHNNQVKGESLDLGQYIDSXFEGPSXLPEDPXKKQFAEELLAYTDAFNKHYTF

SEQ ID NO: 89394 - DNA, 767 bp, Zea mays
  misc_feature: Ceres CLONE 1577026
  misc_feature (532)..(532): n is a, c, t, g, unknown, or other
ccccgcggtggcggccgctctagaactagtggatcccccgaggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttgtctctcatctctgtctgtgacttgaccaacatctcttttggtcctgtcagtctcgcaatactcccttccaaagacttgtctagaggttggattngccctgctctctgctgggactgcagcctggctgaagtctttacttgctgcattctggtgctcacttttgaaagctgctctcttctgctctgcgttgctgatttcctacactcaaccttttcttgccggtgccattaaactttcctcctcctggggaaactaggggacccccttgaagcatttcaacttttaccaaaaaaacctttcttttgtttaaaggaaaaaaagccttatgg

SEQ ID NO: 89395 - DNA, 851 bp, Zea mays
  misc_feature: Ceres CLONE 1577027
  misc_feature: Translation starting site: 556
  misc_feature: SWISSPROT Homolog: EC 4.1.1.31 Phosphoenolpyruvate carboxylase
  misc_feature (851)..(851): n is a, c, t, g, unknown, or other
aagctggagctccccgcggtggcggccgctctagaactagtggatcccccgggctgcaggaattcccctagccccgggaaaaagctagctgtacaagactggcgagacgtgatcgccatctgctggcatatgcagtttctgaaatttgagcggaatcctcatttaccagtatcgaagagttccttgagccacttgagctgtgctacaaatgactgtgtgactgaggcgacaaggccatcgcggacgggagcctcctggacctcctgcgccaggtgttcacgttcgggctctccctggtgaagctggacatccagcaggagtcggagcggcacaccgacgtgatcgacgccatcaccacgcacctcggcatcgggtcgtaccgcgagtggtccgaggacaagaggccccccccggctgctgtcggagctgcgaggcaagcgcccgctgctgcccccggaccttccccagaccgacgagatcgccgacgtcatcggcgcgttcccacgtcctcacggagctaccgctcgaacagcttcgggcccctacatcatctccatggtgaacgggccccctcgggacttgcctcgccgtaaaacctcctggcaaccccaaattgcggccatggcgccagcccgctgccccgtgggggcccctgtttcaaaaaggggtgggccgaacctgaaagtccggggccccgcggtacggggaaagacccctcttcccggggggaacggggacataggaacccggaataaaggggaaagccaccggggcccttggttcaagctacttcccaaattccgggcaaagagaaccccggccccccccttgtccccggtgggtgggaaacn

SEQ ID NO: 89396 - DNA, 2682 bp, Zea mays
  misc_feature: Ceres CLONE 1577030
  misc_feature: Encodes the peptide sequence at SEQ ID NO. 89397
gcttgcccggggcggcgtctcggggactcgcttcctagcagcaccactccttcctccattcctccaagccacgccacacctcggcgcgtcccgccaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaggaccgcccgtccccgcctgccgaggaggacgccaagcgctacgggctcaacgggaacgggagcgggctcggatacgacgatgccgccgtccaagcgtacctcggaagcaacggtaacggtagcgccagcggtaacggcggggcggtgaagcagaaccccgaggttgccgggagcagcgcggccatagtcccggccccggtcccgccggcggagggtgagaggagaaggaaggagagagtggaggagatcgggagggaggatgcctggttcaagcagagcagcgcagaggtttctgttgctcctggtggtcgctggaatcggtttaaaacctattcaacaattcaaagaacactggaaatatggggattcgtttttacatttatattcaaggcttggctcaacaatcaaaagttcacatacagaggggggatgactgaggagaaaaagataatgaggaggaaagttcttgccaagtggctaaaggagagtcttttgagattaggccccacattcatcaaaatagggcaacaattctcaaccagggtggatattctcccacaggaatatgtggatcaactatcagagttacaggatcaagttcctccatttccttctgagacagctgtaaaaattgtcgaagaagagctgggggcatctgtaaatgagatatttgatcgatttgattttgaaccaatagctgctgctagcctcggccaggttcatcgggcacgtctgaatggccaagaggttgtgatcaaagtgcaacggcctggtctgaaggagctgttcgatattgatctgaagaatttaagggtaatagctgaataccttcagaaagtggacccaaaatcagatggcgccaagagagactgggttgctatttatgatgagtgtgcgtctgttttatatcaggaaatagactatatgaaggaagcatttaacgctgaaaaatttgctgaaaacttcaaaaaattggattatgtgaaggttcctgaaatttactgggcacacactactcctcaggttttaacaatggaatatgtcccaggaattaaaattaacagaataaagcagttagataagttaggagtcgatagaaaaagattaggtcgttatgctgttgagtcctaccttgagcagatcttatcccatgggtttttccatgctgacccgcatccaggaaacattgctgttgatgatgtcaatggagggagacttatcttctatgacttcgggatgatgggaagtatcagtcaaaatatccgggaaggattgcttgaagtattctatggagtttatgaaaaggatcctgacaaagtgcttcaagcaatggttcaaatgggtgtccttgttcctactggagatatgactgctgtcagaagaaccgctcaatttttccttaatagctttcaagagcgcctagcagcacaaaggaaggagagagaaatggcaaccgcagagcttggattcaaaaagcaattaactaaggaggagaagtttgaaaagaggaagcagagacttgctgcaatcggagaggatcttttggcgattgctgctgatcaaccatttcgcttccctgccacatttacatttgtggtcagagcattctcagttctagatggtattgggaaaggccttgatcctaggtttgatattacagagattgctaagccatatgccaaggaattgctaagatttaatgacgctggtgttgaaatagttgtgaaggatgcaaagaagagatgggaaaggcagtcccgtgccttttacaatttgttccgccaacccgatagagttgaaaagctcgcacaaattattgaacgtttggagcaaggtgaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcatttttcgggctgcaagttctgatcgggcttgtcaaggttaagaagttggatcggcaggagagactgataaccggtactgcatgagctatgagttattcatgatcaatcggtgagaactgaaccgccacttttcagcgttgtgcgtcgtcgcgacaccttttttttgcttttgcccaaattttacccccaccactatttagcataggcatgcccggttacccctccccccccggttgtatgatagttgtatgtaaatgtgatgataacatataaagatgtacatagtgtataatagacattctcccatgtattgtttcgttttcatgatgtagcagtacgtacaggattttctttctaaaaaaaaaaaaaaaaa

SEQ ID NO: 89397 - protein, 749 aa, Zea mays
  misc_feature: Ceres CLONE 1577030
  misc_feature (266)..(386): Pfam Name: ABC1 Pfam Description: ABC1 family
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSASGNGGAVKQNPEVAGSSAAIVPAPVPPAEGERRRKERVEEIGREDAWFKQSSAEVSVAPGGRWNRFKTYSTIQRTLEIWGFVFTFIFKAWLNNQKFTYRGGMTEEKKIMRRKVLAKWLKESLLRLGPTFIKIGQQFSTRVDILPQEYVDQLSELQDQVPPFPSETAVKIVEEELGASVNEIFDRFDFEPIAAASLGQVHRARLNGQEVVIKVQRPGLKELFDIDLKNLRVIAEYLQKVDPKSDGAKRDWVAIYDECASVLYQEIDYMKEAFNAEKFAENFKKLDYVKVPEIYWAHTTPQVLTMEYVPGIKINRIKQLDKLGVDRKRLGRYAVESYLEQILSHGFFHADPHPGNIAVDDVNGGRLIFYDFGMMGSISQNIREGLLEVFYGVYEKDPDKVLQAMVQMGVLVPTGDMTAVRRTAQFFLNSFQERLAAQRKEREMATAELGFKKQLTKEEKFEKRKQRLAAIGEDLLAIAADQPFRFPATFTFVVRAFSVLDGIGKGLDPRFDITEIAKPYAKELLRFNDAGVEIVVKDAKKRWERQSRAFYNLFRQPDRVEKLAQIIERLEQGELKLRVRTLESERAFQRVAAVQKTIGYGVAAGSLMNLATMLYFNSIRGPATIAYSLCAFFGLQVLIGLVKVKKLDRQERLITGTA

SEQ ID NO: 89398 - DNA, 787 bp, Zea mays
  misc_feature: Ceres CLONE 1577035
  misc_feature: Encodes the peptide sequence at SEQ ID NO. 89399
ctccccgcggtggcggccgctctagaactagtggatcccccgggctgcaggaattcgtctcacccctagaaaaagtctggactgactgactagtgactcagctccacccacatcccccttcgtcgtcttctccctccctgctagctgacctccaatccacgataaggcaagataagctagctaggaaggcaagggatccgatggacaagtacgagcccgttcgcgagatcggggcgggcaacttcggggtggccaagctgatgaggaacaaggacacgagggagctggtggccatgaagttcatagagcgaggaaacaggatcgacgagaacgtgttccgcgagatcgtgaaccaccgctccctccgccaccccaacatcatccggttcaaggaggtggtgctgactcccacgcaccttgcgatcgtgatggagtacgctgcgggcggggagctgttcgagcgcatctgcgacgccgggcggttccacgaggacgaggcgcgctacttcttccagcagctggtttgcggcgtcagcttctgccacgccatgaacatctgccatcggggactcaagcctgagaacacgctgctggacggcagcccggcgccgcgcctcaagatctggcgacttcggctactccaaggtcctcggggctgcactcgcgaccgaagtcaacgggggggcacgccgggcgtacatcgcgcccaaagtggctgtccccggcgaagattacgacggggaagcacgcccgacatctgggccgtggcgggaatcccgcccctact

SEQ ID NO: 89399 - protein, 195 aa, Zea mays
  misc_feature: Ceres CLONE 1577035
  misc_feature (4)..(189): Pfam Name: Pkinase Pfam Description: Protein kinase domain
  misc_feature: SWISSPROT Homolog: EC 2.7.11.1 Non-specific serine/threonine protein kinase
MDKYEPVREIGAGNFGVAKLMRNKDTRELVAMKFIERGNRIDENVFREIVNHRSLRHPNIIRFKEVVLTPTHLAIVMEYAAGGELFERICDAGRFHEDEARYFFQQLVCGVSFCHAMNICHRGLKPENTLLDGSPAPRLKIWRLRLLQGPRGCTRDRSQRGGTPGVHRAQSGCPRRRLRRGSTPDIWAVAGIPPL

SEQ ID NO: 89400 - DNA, 808 bp, Zea mays
  misc_feature: Ceres CLONE 1577037
  misc_feature: Translation starting site: 200
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaaaactatcattgcaaaagcaaagcacgcaatccaatttccctccatttctctagatctcgagttgctctgctacttcttttagattccttctttcgttcgggagagcgattctctagctggtggcaatggcgaagggcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggtgacgccgccaagaaccaggtggccatgaaccccaccaacaccgtcttcgatgccaagcggttgatcggcaggaggttctctgacccgtcagtgcagagtgacatgaagctatggccgttcaaggtcatccctggccctggtgacaagcccatgattgtagtctcctacaagggtgaggagaagcagttcgctgctgaagagatctcctccatggtgctcatcaagatgaaggagattgctgaagcctacctcggctctactatcaagaatgcagtggtgacagtgccggcctatttcaacgactcgcagaggcaagccactaaggacgccggtgtcattgcgggcctcaatgtgatgcgtatcatcaacgagcccactgctgctgctattgcctacggtcttgacaagaggcgagcagctctggcgagaagaacgtgctcatctttg

SEQ ID NO: 89401 - DNA, 1191 bp, Zea mays
  misc_feature: Ceres CLONE 1577040
  misc_feature (13)..(13): n is a, c, t, g, unknown, or other
  misc_feature (14)..(14): n is a, c, t, g, unknown, or other
  misc_feature (58)..(58): n is a, c, t, g, unknown, or other
  misc_feature (1191)..(1191): n is a, c, t, g, unknown, or other
tcgtcttggtttnntttttttctgtttttggcattgcgggccatagcatgtatagatnctatggttttagtgtgtaaaactggactcccctcggtggcggccgctctagaatagtggatcccccgggctgcaggaattcgtctcacccctagaaaaaaccaggccagaggccaccgcttgccctttcttccctgccggctgccgcgctcctaataattgcatcgccgccccatgtccgccctgcttattcttgtggctagcctcgctgcttagtgcttatatcaccattcaccagctagcttctcaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcaaaagcaggggaaccttgtccgcggctcggccggcattgaactcccgctgctgggtccgcctgtggccggggcctgggggccctgccgacgggcgggggcccgccccgaaacacggccccccgggaaccccggccaaaaacccctccgcttgcccgagacccacccttgtagcttgccatgccttgaaaacaaccgccctctttattcttggccaccccacaaaattcccaattggggtcccctatcaccaggcttatttatcacaaatatttattctttactacggtacacaataacagaatatgcggtttccaattttatcccctgtagcacatattgttgtttgtccccccgtgtggggggcccaaataaaaatacgacccccgtgggagtcgcgtccccggtatagtgaaaaagactccctcccgtggcgcgccgcgcggcgtatgaaaacaaaacactagaaataataccctccccacacaattccacagttattggtataaaacttatagattcccaccacccccacatgagtggaggcgacatctcttccttacgaggggaggggggaccccaaacataacccatacacgagaggttcccacccaaataagggtgcccgaagatagaaacacgggtatatcccatataagaacccctgaagaatgtgacggcgcgcacagcgaagcttttactcccctcactcccagctgagatagccgcacataaaaacatattgtgtgggggn

SEQ ID NO: 89402 - DNA, 789 bp, Zea mays
  misc_feature: Ceres CLONE 1577042
  misc_feature: Encodes the peptide sequence at SEQ ID NO. 89403
tggagctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtcttgacaagaaggcaaccagcgtcggtgagaaa

SEQ ID NO: 89403 - protein, 199 aa, Zea mays
  misc_feature: Ceres CLONE 1577042
  misc_feature (9)..(199): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEK

SEQ ID NO: 89404 - DNA, 948 bp, Zea mays
  misc_feature: Ceres CLONE 1577043
  misc_feature: Translation starting site: 258
  misc_feature (855)..(855): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
ctggagctccccgcggtggcggccgctctagaactagtggatcccccgggctgcaggaattcgtctcacccctagaaaaaatccccgcttgattagcggcagccactctctccctctccactcttggtgtccgagtcccttggccgtacgctctgcctcactccgtctcttgcttctcctgccgccggcgtcggagagcgagcttctcggcgggcggcggcggcgcgcggcgctgggtgcggatcggccgcgggtgcatggtggaagccgccgccgggcgccggtcaggcaccagccgtcggcggcctagcggcagcggaggggagcaccagcgcctggttgcgctcgccgtcgccgcgcgcttcgccatggtcagcacccggtctgcgggtccagcagtggcgggaggagatggagcgggagctgctggaacaggcgccggccccgctgccggtagcggacgatgcatggaggacttcttcgactgcctcctcggcttgctcggcgcgttaggcatgacatgggctacggcgcggccccagcggcagccgctcccgccgctgcctcgcgggggttggggcggggcctgagccaaccgacgcccggcgtttcgcagcggcgctcagggccacccccggccggatcgctggcaatggcgcctgcgccgtcgcgtcactgtacacgctgcaggtcaagaagggcgtcaaccaggatgctatgatcttctgggagaacttctgttctagagatgataccatcttttgtggtgtatttgatggtcatggaccttatggccatttggttgcccagagagtaagagactctccatagatggaagagccgctccaggctatnccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 89405 - DNA, 801 bp, Zea mays
  misc_feature: Ceres CLONE 1577047
ctggagctcaccgcggtggcggccgctctagaactggtggatcccccgggctgcaggaattcatctcacccctagaaaaaccaggccagatgccaccccttgccctttcttccctgccggctgcctagttcctaataattgcatagatgcaccatgtccaccctgcttattcttgtggctagactccatgcttagtgcttatatgaatgttctacacctaggttaacaacagctacatcaccttcgccagctacctgctgctgccccagatggctaggtcttcttctacattgtcaacgactgactgactgactgggacaacaagctcccgggagaccacctgcgtgctgtaaccgcagcgcatatgcctgaaaaccttgtacgcggactcagaggcgatgaacctgccactactacctccgctgcggaaggtgctgatgcacgccgcgcccgtgcccccctacaagttaccagagccggccaaggcccccctgcccgacacgtggctgcagctgcacgcgcacgtcttcgccaaatccttggtcgttgggttctgcttctactgcatcaaagtcttcatcctcttccgtgtgtacccggcgcatcaaacttcgatgacgaacctcgtactctccttgtagtctctcccaccggcctgtgaccccatctgacggggggccgaacggaccaccggcccaacgaaattaatcaaactaaccgtggggttctggcgattccagccaacgcggatgttaacaccccaacgggaacacatttgaacacctatgggcgccctggccc

SEQ ID NO: 89406 - DNA, 821 bp, Zea mays
  misc_feature: Ceres CLONE 1577049
  misc_feature: Encodes the peptide sequence at SEQ ID NO. 89407
ctccccgcggtggcggccgctctagaactagtggatcccccgggctgcaggaattcgtctcacccctagaaaaactccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgccttcggccaaggccgcggtagagagcctccagccggcgatggagagtctgcatgtgcaggattacaaggacgcgcctccggccaagggcgtggccgccgccgccgccgtagggagcttgcagccgggggcggagaacctgcaggtgcaggactacaaggacgctaacatgtattatggtgcttacccggcttatgcctatggagcctatggtggctggggggagtacccatacctgagccatgatggagcacagacaccaactgctggtacctatgctgacatgtactatggctatgctccatatggtgttgcaaccatggggcatgatggtcagatttatgggtcacagaattaccagtacccgtcgacatacaccaagcaacagaactctactgccaagctgtcatccaatggtataagtgagaaattgactccagcgccacaaacagatgtatctactattgggtgtgaatgaaggtgaaaagttttgaaaaattcaaatttcggtgcttgagacagaa

SEQ ID NO: 89407 - protein, 180 aa, Zea mays
  misc_feature: Ceres CLONE 1577049
MAAVGSLKPGMETLHVQDYKDAPSAKAAVESLQPAMESLHVQDYKDAPPAKGVAAAAAVGSLQPGAENLQVQDYKDANMYYGAYPAYAYGAYGGWGEYPYLSHDGAQTPTAGTYADMYYGYAPYGVATMGHDGQIYGSQNYQYPSTYTKQQNSTAKLSSNGISEKLTPAPQTDVSTIGCE

SEQ ID NO: 89408 - DNA, 973 bp, Zea mays
  misc_feature: Ceres CLONE 1577054
  misc_feature: Encodes the peptide sequence at SEQ ID NO. 89409
  misc_feature (47)..(47): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
ggggggggggaaataaataaagaggaaagtgagagaaattacataanttaaaagaagaannnnnnnnnnncaaaactggagctccccgcggtggcggccgctctagaatagtggatcccccgggctgcaggaattcgtctcacccctagaaaaaagtggggctcctcggtcccggcgttggccgcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgttctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactttgttctgacttacaccgatgaggatggtgatattgtcatgctagatgatgatgatgacttgcgtgatgcagctctccgtcagagattaaaccctctcaagattactggttcaactgaagaaaaaatcaaccaaactgaaaaaaaaaagataccttctgccccagtggaaaatccgctgtctcagggatcccactaatcccaggttaaatggtcaacttatttaaagggttttgaaaacctcggttcaagggaaaaaaaagtttgggccccattatttaaatccacggttatttggggagaaagcaaaatccaaggaccctaatcccacagaaaactccaaatacccctggaagtggccccctttggcaaaaaaaatttgtgcttcaata

SEQ ID NO: 89409 - protein, 133 aa, Zea mays
  misc_feature: Ceres CLONE 1577054
MSDWSSPAAPTFFPFGPQAEGWDVTFKVKYGDTLKRFYGCANGSHFDMNLSALRARIDTAFKFGPDVDFVLTYTDEDGDIVMLDDDDDLRDAALRQRLNPLKITGSTEEKINQTEKKKIPSAPVENPLSQGSH

SEQ ID NO: 89410 - DNA, 905 bp, Zea mays
  misc_feature: Ceres CLONE 1577057
  misc_feature: Encodes the peptide sequence at SEQ ID NO. 89411
ctccccgcggtggcggccgctctagaactagtggatcccccgggctgttggaattcgtctcacccctagaaaaactgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgaccgccgccaccggcgagggccttgtgcggtagctcggagtcctcgacctcgtgctgctcgggatcggtgcgtccatcggcgccggcatattcgtcgtcactggtaccgtcgcccgcgacacctgtccacccccaccatcagttttgttcttgctggagctgcgtgcgtgctcaatgccctgtgctatgctgaactggcgtctcggttccctgctgtggttgggggagcatacttgtccacgaacgcatcgttcaatgagatcaccgccttcttggccttcacctcagttgaaggtggaaaaccattatcggggcaccaagcattgctgcaagtttatgcagcgactttttccaaattcttggagcttatccccgcttttaaagggcccaaattccaggctggggtaggcccagggggaaggaatttttttgggggggggtgggatccatctaacaaaccggggccccccattccttctccttcacctgaaaacgggaaaatccccgctctggggggccaaaggaagaaatcccccgggggaaaaccctttttttggaaacccgggggaagaaacaaatagggtgtagaggccagttctccctttttgctgggggggttttttaggggaggattgtttccccacag

SEQ ID NO: 89411 - protein, 231 aa, Zea mays
  misc_feature: Ceres CLONE 1577057
MEEARDHRLSSTAGRPFLSGFCAAALRRKPLGARASAADRRHRRGPCAVARSPRPRAARDRCVHRRRHIRRHWYRRPRHLSTPTISFVLAGAACVLNALCYAELASRFPAVVGGAYLSTNASFNEITAFLAFTSVEGGKPLSGHQALLQVYAATFSKFLELIPAFKGPKFQAGVGPGGRNFFGGGWDPSNKPGPPIPSPSPENGKIPALGGQRKKSPGGKPFFWKPGGRNK

SEQ ID NO: 89412 - DNA, 868 bp, Zea mays
  misc_feature: Ceres CLONE 1577058
  misc_feature: Encodes the peptide sequence at SEQ ID NO. 89413
  misc_feature (851)..(851): n is a, c, t, g, unknown, or other
  misc_feature (852)..(852): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
ggagctccccgcggtggcggccgctctagaactagtggatcccccgggctgcaggaattcgtctcacccctagaaaaactgtttcctttctcctcctcctccaaaagcagctcctttctcgggggtccggccacttccaggagttcttgcctgcgaagcttgctccgttctttcgcctgcttgccctcactcctctatcgccttggcctgcttattgcccagacagtttctgcttgaccccacgattcttcactgatgattcacagaaagcttggcgagcacgtacataacttgccgatcggacagttgatggacggcacgagcccaaaccgtgcaagtccacaataatttctccctccggctccggctccgcctagactcactcgtccatgtcgcgcgccggccgctccctgcccctgcccgtggcggcgctcctgctcgcggtggtggcgctgtgcgcggcgcggcgcgcgcgcgcgatcggcgtgaactggggcacgcagctgagccacccgctgccggcgagcacggtggtgcggatgctgcaggacaacggcttcaacagggtgaagctgttccaggccgaggacgccatcctgggcgcgctcaggggctcgggcctccaggtcatggggggcatccccaacgacatgctcgccggcctggcccccggcgggaaagccgccgcccaactgggtcgccaagaacgtctccggggcaactcccgcgacgagcgtcgaacataaggtacctgggcccgtgggcaaaacaagccggttcccgggaagacgttccaacggggaacgtaccctaaaccacggacggtttcccggggcgataccaaaaaccgnncccgcgcgcggnnnnc

SEQ ID NO: 89413 - protein, 118 aa, Zea mays
  misc_feature: Ceres CLONE 1577058
  misc_feature: SWISSPROT Homolog: EC 3.2.1.73 Licheninase
MSRAGRSLPLPVAALLLAVVALCAARRARAIGVNWGTQLSHPLPASTVVRMLQDNGFNRVKLFQAEDAILGALRGSGLQVMGGIPNDMLAGLAPGGKAAAQLGRQERLRGNSRDERRT

SEQ ID NO: 89414 - DNA, 753 bp, Zea mays
  misc_feature: Ceres CLONE 1577063
  misc_feature: Encodes the peptide sequence at SEQ ID NO. 89415
  misc_feature (527)..(527): n is a, c, t, g, unknown, or other
  misc_feature (532)..(532): n is a, c, t, g, unknown, or other
  misc_feature (533)..(533): n is a, c, t, g, unknown, or other
  misc_feature (545)..(545): n is a, c, t, g, unknown, or other
  misc_feature (558)..(558): n is a, c, t, g, unknown, or other
ctccccgcggtggcggccgctctagaactagtggatcccccgggctgcaggaattcgtctcacccctagaaaaaactcccagtcccaaacccatttcccttgccttcccctccggctccgcctcctcgaccactccgacaaccccagcgcctccggcgagctccacccctccaccggctgcggcgagaagcggcgggggctaactaagtctgtaggcggcggcggaggtgatccgggagccggagccgagtctagggcgatggggcagcagtcgctgatctacgcgttcgtggcgcgtggcaccgtggtgctggctgagtacaccgagttcaccggcaacttcaccaccatcgccgcccagtgcctgcagaagctccccgccagcaacaacaagttcacctacaactgcgacggccacaccttcaactacctcgtcgaggacgggatcagtgagtagttccgctccccgtcgctccgatccgcgctgccccgcacggatccgcgccgccgcggggctcggatcgggnctcgnnctcgctcggctnacttggatctcgnctcgaccccgggcctgctgggggctcagggtccgccgcttccaggtgggtagggggggggtcagattcggggggtgctttcaggcttaatctgagtgaaacggggctgttggctttacccccttcagctgttttgggaccccccccttaaattgtgaaaaaaaaaaacgggtttttgggaggggccggaaaatta

SEQ ID NO: 89415 - protein, 65 aa, Zea mays
  misc_feature: Ceres CLONE 1577063
MGQQSLIYAFVARGTVVLAEYTEFTGNFTTIAAQCLQKLPASNNKFTYNCDGHTFNYLVEDGISE

SEQ ID NO: 89416 - DNA, 1084 bp, Zea mays
  misc_feature: Ceres CLONE 1577065
  misc_feature: SWISSPROT Homolog: EC 1.3.3.4 Protoporphyrinogen oxidase
  misc_feature (1)..(1): n is a, c, t, g, unknown, or other
  misc_feature (64)..(64): n is a, c, t, g, unknown, or other
nttatgtttttattttttgtgggggggggccctctatcttctagcgggtggggggcgggtattnacctctgttttgaaagctggagctcaccgcggtggcggccgctctagaatagtggatcccccgggctgcaggaattcgtctcacccctagaaaaaatcactccgccgcacaggcgctcagctccgcaacgccgccagaaatggtcgccgccaccgccaccgccatggccaccgctgcatcgccgctactcaacgggacccgaatacctgcgcggctccgccatcgaggactcagcgtgcgctgcgctgctgtggcgggcagcgcggccgaagcaccggcttccaccggcgcgcggctgtccgcggactgcgtcgtggtgggcggaggcatcagtggcctctgcaccgcgcaggcgctggccacgcggcacggcgtcggggacgtgcttgtcacgaaaggccgcgcccgccccggcggcaacattaccaccggtcgagcgccccgagggaagggtacctctggggaaggaggggtcccaatcagctttccagcccctcccgaaccccgttttctcacccatgggcccgtgggacaaccggaacctgtaaaggaaggaacttgggggttttttggggggggaaccccaaaaaccgccgccccgccggttttttccgttgcccttgtttgggggaaggggggagaaaaagcctgtgaaagggccccccgggtggggcccatattccgcaaaaggccccccgggcccgggaaaccctttccccccgggtttcccctttccggagttccttccatgtggaaacacatttcccccacagggggataaaggcctttcaagaggggcccccggggtccttatgggggcgccgcccttttggggaaatttccaggggccacggaccttcccctccccagggtgttccggggggcttctctcccccccagggccctggcaatttttttttaaaaatccctgtggggggggctttgaaaattgtgtggggcgcctcggcccacccgggggggctctaaaacactttttccttgtgcgaggaaaaggtttta

SEQ ID NO: 89417 - DNA, 860 bp, Zea mays
  misc_feature: Ceres CLONE 1577066
  misc_feature: Encodes the peptide sequence at SEQ ID NO. 89418
ctccccgcggtggcggccgctctagaactagtggatcccccgggctgcaggaattcgtctcaccccctagaaaaaaacctgcagtcagacttaccaccaagtggacgcagcagctttaaccccccaaagcctcgacgccgcgagcacagctccgccgccaccgcccccttctcatccgcggtctccgccgcctgctgcatctctatcgatctagcgggactggctccttcccgtgctgggtccttcgtcaatcgtcagcgcgcaagatcggcacttgtgtacatctgagcagtttccggtgccctaattcaggcgcgggcgttgttgggttttcgataattttgggggttcacctgaaccctcatgacccaggtgaagcccgcccctgggggaaggatgctgaccgtgctgcgggtgcacctcccgtcggagatcccgaatcgtcggctgtgagatcacgccgtatgtgctcctgcggcgcccccgacggaggcgtcttcaccgacgacgtggctgagaccgcgcccgtggatgggtacttcatgccctacaagtggtaccgcatacaaagtgatcgtagaagtgctatctgcaggggtacacccaacaaaacaagccaacacttcaagggataggggcctctgaaagcaaaaaatcactgttggctaaaaagctacccattgggtctctctaaaggccttcacccaaaggctggggaaacacccacaaagggttttggcaatgaacggggacataaagggggctcttaaaatgaaaaaccggaaccccaaaaaaggaaggagtttggtttggggaaaattttggggaagcagccaaattccgaagctcccgagggggta

SEQ ID NO: 89418 - protein, 56 aa, Zea mays
  misc_feature: Ceres CLONE 1577066
MCSCGAPDGGVFTDDVAETAPVDGYFMPYKWYRIQSDRRSAICRGTPNKTSQHFKG

SEQ ID NO: 89419 - DNA, 929 bp, Zea mays
  misc_feature: Ceres CLONE 1577067
  misc_feature: Encodes the peptide sequence at SEQ ID NO. 89420
  misc_feature (400)..(400): n is a, c, t, g, unknown, or other
ctggagctcaccgcggtggcggccgctctagaactagtggatcccccgggctgcaggaattcgtctcacccctagaaaaaaagcctgagcactccatcgactactttactcaaagtctagagctagactttttgctttgctcattatataaaccgcatcacatggcgtcgacgattgtggtcgccacctcgctcattatcactgccaaaacgccgtttcttggtcagggtcgtgccgccgccgccgccgactatgccattgctctccgcaacgttctcgtcgccgctgctggcggacggatcacgatgggctatgacgtgtggtactgcccggaccgcatgcagtagcatgggcccttctccgcccagacaccctcataactgagagggtatttcccccnccaccacagatggaacaccgaacggctatcggtggagcctgaggcgtacgcacaccaacagggccctggaagtgatgccaccttcggcaggtagatactgggctgcactggactgcatcgccccgggaggttcttagataattaggggcggcgtcgactttcaaggagcactgggtggatccagggaaaggggcgcccaatcttttccggacggccggggctagaactattggggaaatccccaaccctggttttattggtgaaagaaatttttgccgggggtccggattacgggcccattttcttggggctctccccagagggtgttcaaatttaaaagctttcaatgggttttggaaagggggagagaacactttttttcggggggggaaagaaaattgtaaccgccctggggcctttgtcaaaagaaacccagtacgctttttggcaaacctctcagggttaaagagaaaataaaaaaaaggccccccccccccgtggtactcagagtgttggggatttcttggga

SEQ ID NO: 89420 - protein, 61 aa, Zea mays
  misc_feature: Ceres CLONE 1577067
MASTIVVATSLIITAKTPFLGQGRAAAAADYAIALRNVLVAAAGGRITMGYDVWYCPDRMQ

SEQ ID NO: 89421 - DNA, 901 bp, Zea mays
  misc_feature: Ceres CLONE 1577068
  misc_feature: Encodes the peptide sequence at SEQ ID NO. 89422
  misc_feature (481)..(481): n is a, c, t, g, unknown, or other
  misc_feature (509)..(509): n is a, c, t, g, unknown, or other
agctccccgcggtggcggccgctctagaatagtggatcccccgggctgcaggaattcgtctcacccctagaaaaaatatactattaagcagctcccaatctttggcatttgcaggcacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgtctgtcacggccacccacacatggcaagcgatccgggagcagagcgtgcgcgtgacggaccctatgctgtcncctgctgatcgcgtgcatgatggcctcncctgcgtcccagctgctgcccaaggccatcttgaacccgcggccggggttagggccctggacggggcggaacttcaaaggggcgtaacaaacaggaaggggcacccccccccggggggccccggaattccgggaacccgggaggaaatttcggggcggaacccaaaaaggggtttttttaaagagggaacccggggaaaatttggggggggggaaaaatcccccccctaatataaagaggggggccccccccccccgggaggaaggggtggggccccaaaaaaaaaaaataagggggccaccccacaaaaggggaaaaatttggtggtgttgcgccccccgctccaaaaaaaaaaagggggggggaacaccccccggcgggcaataaaaagt

SEQ ID NO: 89422 - protein, 190 aa, Zea mays
  misc_feature: Ceres CLONE 1577068
  misc_feature (115)..(115): Xaa is any aa, unknown, or other
MGFFIPPPKVYKPAAEVDLGPDSDEHYISPNVKAPRVAGFLVKMLAWVLETPVLGWIVLGVLKRDNLVYKLVSDAEIPEPPSVTATHTWQAIREQSVRVTDPMLSPADRVHDGLXCVPAAAQGHLEPAAGVRALDGAELQRGVTNRKGHPPPGGPGIPGTREEISGRNPKRGFFKEGTRGKFGGGEKSPP

SEQ ID NO: 89423 - DNA, 964 bp, Zea mays
  misc_feature: Ceres CLONE 1577073
  misc_feature: Encodes the peptide sequence at SEQ ID NO. 89424
tccccgcggtggcggccgctctagaactagtggatcccccgggctgcaggaattcgtctcacccctagaaaaagtgtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccctcaaggatcttccggggaccagggggaaagaacatttccgggaattaccaggggcccctaagggaggcttgaagggcattggtgggaatttactttaaagaaagccaggtttgggccctggccttcccaaggaagaattcaaggtcccccaaaaaagaagtgccaacgggcccccttttatcgaatgaacaaggaaggaatccttaccatttggttggggaatcctttcgcctggaaatttcgacgcggcaccccggaaattttaccaaaactttccggggggagggtccgccagaaagaaagccgtaaggtctctggacttaccgaacttttttggcccccacccttttggctaggggcaagaactaccctttcccaaagggtgggggaagtgcccgccattggggaaacgcggccccactttggtttcacggggcttgccttgtaaaccccctttttggaatgaaaaccttgtgtttgtttttaaccagcccgag

SEQ ID NO: 89424 - protein, 145 aa, Zea mays
  misc_feature: Ceres CLONE 1577073
  misc_feature (35)..(143): Pfam Name: Thioredoxin Pfam Description: Thioredoxin
  misc_feature: SWISSPROT Homolog: EC 5.3.4.1 Protein disulfide-isomerase
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIQGFPTLKDLPGTRGKEHFRELPGAPKGGLKGIGGNLL

SEQ ID NO: 89425 - DNA, 758 bp, Zea mays
  misc_feature: Ceres CLONE 1577077
ctcaccgcggtggcggccgctctagaactagtggatcccccgggctgcaggaattcgtctcacccctagaaaaagtcagccacgcacccgcctcgcctccagtcacagcgaccacgcccatcttcgctctgggcgctcacccccacctctccgcccccgtctccgtccgcacccgtgcgcctccgacttccccgtggcccagccggatccggagccgaactccaccttgttcaggaaggagagcccgaaccgcggcgggggggagggctctttttatcttgccccgcctgaggccaaccgccccatgggccagtcgcctgagcgcgctacgtatcatgctcatcgaccggcgggaagggcttgggtaaatcattattgaaagcatcgccctgtttcatgtaaccttgcatacgatgtctgtcaagatgagtccactgaataaagctgtttcgaatagtggagatgcatgtgcagccgaagctagtaaagtctcgtcattaaatcccaatgcagcggagtgtgtaccgacatttgttaaaccatcttgttggaaacggtagctctcgagataagtcacatttcaggggggtctgctgggaaaaactattctggataggccctgacccatcaaaggcttattactcagatgatgagggcccaccagtttttggcccttaaccaactgtccgggatgactttattcccgtatcttcactttctttttgaaaaaaatttaaaccaaggggcctgtgaactga

SEQ ID NO: 89426 - DNA, 975 bp, Zea mays
  misc_feature: Ceres CLONE 1577079
  misc_feature: Encodes the peptide sequence at SEQ ID NO. 89427
  misc_feature (831)..(831): n is a, c, t, g, unknown, or other
  misc_feature (857)..(857): n is a, c, t, g, unknown, or other
  misc_feature (912)..(912): n is a, c, t, g, unknown, or other
ggagctccccgcggtggcggccgctctagaactagtggatcccccgggctgcaggaattcgtctcacccctagaaaaacacagcaccaaccccgacaccaccgttggcagccgcaacccgcaaccagagccatgggcctcttcggcaagagcacctccaagcagaccgccaagctcaaggccctggtcaagctcgccgcggcgcgcctcgccgtcgtccgccggccgcgcctcggccgccggtccatcgcccgtagcgacgtcgggcagctcctctctatcggccatctcgaccgcgcgctcgtccgcgcggagcaggtgatcgaggaggacaacatgctggaggcgctgaacgtcatcgagctctactgcaaaatcctcgtcgagcagaccgcgcagctggagaaaccaaaggaatgcagcgaggagatcaaggaggcggcggcggggctgatgttcgcgtccgcgcggtgcggcgagctgccggagcttctggacgcgcgcgccatccttgcagacaagttcggccgagacttcgccagggcggccaaggagggcgcccacggcgtcgtcgaccccacgttggtgcggaagttgtccggcgagagggcgagcgtggagcaaacgaggaggttgacgaaggagatcgccgccgagaacgacatcttgctggagttccctgagagcccagtagggattcacaaagatggtcgcacgacctcgcaggtcacagtcagagagcaggtgaggaaactaagaatgcaccggcccagacatttgtcgaggagagtgcagtcagacggatcgccgtgagggggaagcgaatctgttnacggcaaggtgaccccgagctgtcanctaccttggatgaaaaggtgtgagggaatccagagtacccgacccaggatgcggncgaagcagcttccggtcgcaagtccccgcatgccccccggctgcgtcaactttctcgcggaat

SEQ ID NO: 89427 - protein, 226 aa, Zea mays
  misc_feature: Ceres CLONE 1577079
  misc_feature (21)..(142): Pfam Name: DUF292 Pfam Description: Eukaryotic protein of unknown function, DUF292
MGLFGKSTSKQTAKLKALVKLAAARLAVVRRPRLGRRSIARSDVGQLLSIGHLDRALVRAEQVIEEDNMLEALNVIELYCKILVEQTAQLEKPKECSEEIKEAAAGLMFASARCGELPELLDARAILADKFGRDFARAAKEGAHGVVDPTLVRKLSGERASVEQTRRLTKEIAAENDILLEFPESPVGIHKDGRTTSQVTVREQVRKLRMHRPRHLSRRVQSDGSP

SEQ ID NO: 89428 - DNA, 796 bp, Zea mays
  misc_feature: Ceres CLONE 1577081
  misc_feature: Encodes the peptide sequence at SEQ ID NO. 89429
ctccccgcggtggcggccgctctagaactagtggatcccccgggctgcaggaattcgtctcacccctagaaaaaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgaggggttcgaggcgggggagggggacaacgaggagctcgccattgccaggctcggcctgcccgacgagctcgtcgccacgctcgagaagcgcgggattacgcacctgttccccatccagagggctgtgttgattcccgctctcgagggccgtgacctgattgccagagcaaagactgggactggaaagacactggcctttggcatacccatgatcaagcaattaatcgagcaagacgatggtcgggattacaagggagaggtcgtactccctcggggttctgggttctagcaccctacccagagaggttagccaaaccaggtcggaggagggagaataaaggaaattccgcaccccaagcttcgggcacaggtggggtggttttattggcggggtgggccccaatattaaagggtcccaggcagaaatggaacactcctct

SEQ ID NO: 89429 - protein, 171 aa, Zea mays
  misc_feature: Ceres CLONE 1577081
MASLTLPALALALSNPGAVRLRAAAFRCWALRRRGWAAAGALASPNSVLSEHAFKRLQLGSDDEDGEGPYGSDADEGFEAGEGDNEELAIARLGLPDELVATLEKRGITHLFPIQRAVLIPALEGRDLIARAKTGTGKTLAFGIPMIKQLIEQDDGRDYKGEVVLPRGSGF

SEQ ID NO: 89430 - DNA, 969 bp, Zea mays
  misc_feature: Ceres CLONE 1577086
  misc_feature: Encodes the peptide sequence at SEQ ID NO. 89431
  misc_feature (423)..(423): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
ctccccgcggtggcggccgctctagaactagtggatcccccgggctgcaggaattcgtctcacccctagaaaaaagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacgacagacgagcagtagcagcagcagcagcacgaggcggccgggcccgggccacgccatgccggagaaggaggcgcaggccgccgcgttctgcggcgaggcggtgatcgccgagttcgagtccctcacgcgggacgcctgcgccgtgcagcgcgacacgctgcgccggatcctggcagacaacgcctgcgccgagtacttccgcctgcggggcttncgggggccgcaccgacgccgccagctttcgccgccttgggtggcggtttcgccaaggaggccgaaattcggagccttaaaattgggcggattttgccgagggggaaacctttcccccgtgggcttcccgcaaaaccccataaccttcctttttccctataattcccgggaaaaaaccgggggggaaaggccaaaaatcctttccctttttaccccggaagcttttttaaaggctcccaagatggaaattatccggggtttttttctcccccttttggagaaaaaggggttttctccccttggaaagaaaaaaaaagggccttttattattttttttgtggggggggggggggtttttccacccccaggggggggtgttttattggaaaaaacccccccccccccacaatttttttcctccccggggagaggtttttttcccccaagggggggcccctcttttttaggggggggggtcccccccccgggagaggggtttttttttcgggcccaattttttnnnngcgtttttctttttcgcgggggg

SEQ ID NO: 89431 - protein, 235 aa, Zea mays
  misc_feature: Ceres CLONE 1577086
  misc_feature (53)..(53): Xaa is any aa, unknown, or other
  misc_feature (227)..(227): Xaa is any aa, unknown, or other
  misc_feature (228)..(228): Xaa is any aa, unknown, or other
MPEKEAQAAAFCGEAVIAEFESLTRDACAVQRDTLRRILADNACAEYFRLRGXRGPHRRRQLSPPWVAVSPRRPKFGALKLGGFCRGGNLSPVGFPQNPITFLFPYNSREKTGGERPKILSLFTPEAFLKAPKMEIIRGFFLPLLEKKGFSPLGKKKKGPFIIFFVGGGGVFPPPGGGVLLEKTPPPPQFFSSPGRGFFPPRGGPSFLGGGVPPPGEGFFFRAQFFXXVFLFRGG

SEQ ID NO: 89432 - DNA, 881 bp, Zea mays
  misc_feature: Ceres CLONE 1577091
  misc_feature: Encodes the peptide sequence at SEQ ID NO. 89433
  misc_feature (500)..(500): n is a, c, t, g, unknown, or other
gagctccccgcggtggcggccgctctagaactagtggatcccccgggctgcaggaattcgtctcacccctagaaaaagacccagaccttcagatctcccttcccttccgttcctgttcctctctattaagcagcaagcaaagcgccactctcaatccacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggggagggtctcaatggggatcggntagttgatgcgcctttacagcttgattttccgtgacaaagttgagtcaaggcagtttgctcaagaagcttactaccgaggatgttatgaattcccggaatgcattggctaaagactcctacttccagaaggcacaggaggatctccccctggggggcgttctccggataatttaaaagagggggcaaggaaaaatccagggcaggggaaaatctttttggtaggggcaatattttttgaaattctaaaaaaaaaagaccgggggatcaaaaacaaggggccccctgataaaaggggtttggtttcccctcaaaaaaaaaaaagaaacaaatgggaaatttccttttccccccacggggaaggagaccccacaccttttgag

SEQ ID NO: 89433 - protein, 94 aa, Zea mays
  misc_feature: Ceres CLONE 1577091
  misc_feature (84)..(84): Xaa is any aa, unknown, or other
MAALRAPAATLLVLLALAAAGGVAADGSDHRYKIREPVPLYANKVGPFHNPSETYRYFDLPFCSPDKVKEKSEALGEGLNGDRXVDAPLQLDFP

SEQ ID NO: 89434 - DNA, 765 bp, Zea mays
  misc_feature: Ceres CLONE 1577092
  misc_feature: Encodes the peptide sequence at SEQ ID NO. 89435
  misc_feature (765)..(765): n is a, c, t, g, unknown, or other
ctctccgcggtggcggccgctctagaactagtggatcccccgggctgcttgaattcgtctcacccctagaaaaaatcgggcgcgaggggagaaagataggagtcaatcaatttgcctgttctgcttgcttcctgctgaccttgtgacggagtgagccgccggtcttccgcttcctcgccgaggggaaataataagccagccacagccagggccgccccgaggaagaagatgagctgatgatgcgtggaccgacctccggtcgccgagttccggctgacggtgacgcacggcggccggttcctgcagtacaacatattcggcaacctggtctagatcgcgcacaagtacctgccccccatcatgaccatcggccgcggcgcctacaggatcgtcgggtacattctcgcgaactgctcggtctcggctgcttgggccgccgtgtggctgatttttctcgcgaactgcagcagatggttgccatgtgttagggacttgttcactagctactcactcattgggatgatggatgggcatggattgatgggttggacctggaccaccgtaccgataggctctttatttgatcctgcacaggcgcttgttttatgttgatagcaatttgatcctagttctgggggaagaaagcggaagacaatactgatccggtacttgcactaacagacgggacggcgcgcgatattctggtgatggaaactccgatgaacgaatgcagtatcggtgggccccctccaagatagaatcgcn

SEQ ID NO: 89435 - protein, 83 aa, Zea mays
  misc_feature: Ceres CLONE 1577092
MTIGRGAYRIVGYILANCSVSAAWAAVWLIFLANCSRWLPCVRDLFTSYSLIGMMDGHGLMGWTWTTVPIGSLFDPAQALVLC

SEQ ID NO: 89436 - DNA, 894 bp, Zea mays
  misc_feature: Ceres CLONE 1577093
  misc_feature: Encodes the peptide sequence at SEQ ID NO. 89437
  misc_feature (544)..(544): n is a, c, t, g, unknown, or other
ctggagctccccgcggtggcggccgctctagaactagtggatcccccgggctgcaggaattcgtctcacccctagaaaaacttgcggtgagaaacacggtgtcgccctcgaggctcgaccccgaccttttcctcccctcttctctagatcgcgacgaggcggactccccactcctgctgcccggagcgaagcggaccgcgtccccgccgcgtggcctgatcgatccctcagctctgccggtcgggccaatgctgcgtgcatcgagctgccgctgatcacgttcttcgcggttgcggcccccagtttgtgcggtgtggcgttggcggaaccttgtggaggctagttgctccaggactttgattttgacttatctatggaaatggatgactcacatggcaccatggttaataaaagtgaagagaatgactttgaaaagaaaggcacttctgatcctgtggtttatcagctagttcgggttgaaggtgatggaacacttgttcctgctacagaagatgatgttttgcagtttgaacatttccttcancacgaggaaggtgatcttccctcctattgagatgcagaccatgtgggaagaagttttcaacaatgactgcatggtactggagaagcctgacttggaagatggatcttccaaattggagactgtgggagcacacacccaaaaattgggtgcccacctagaggaaaacatattacagtcattggatgaatcccctagtcctccccagactttagaattcctagcagcattccgataaatgcctaccgaacaaggggcaacgttcctcgacagaacatgcctcacgaaactcaaaattcgacaggttaaaggaacctggcgggctgaaaaataaagctgagccggctcaaatc

SEQ ID NO: 89437 - protein, 66 aa, Zea mays
  misc_feature: Ceres CLONE 1577093
  misc_feature (57)..(57): Xaa is any aa, unknown, or other
MEMDDSHGTMVNKSEENDFEKKGTSDPVVYQLVRVEGDGTLVPATEDDVLQFEHFLXHEEGDLPSY

SEQ ID NO: 89438 - DNA, 1052 bp, Zea mays
  misc_feature: Ceres CLONE 1577094
  misc_feature (63)..(63): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (415)..(415): n is a, c, t, g, unknown, or other
  misc_feature (427)..(427): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (729)..(729): n is a, c, t, g, unknown, or other
  misc_feature (735)..(735): n is a, c, t, g, unknown, or other
  misc_feature (736)..(736): n is a, c, t, g, unknown, or other
  misc_feature (845)..(845): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (869)..(869): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (882)..(882): n is a, c, t, g, unknown, or other
  misc_feature (884)..(884): n is a, c, t, g, unknown, or other
  misc_feature (905)..(905): n is a, c, t, g, unknown, or other
  misc_feature (921)..(921): n is a, c, t, g, unknown, or other
  misc_feature (934)..(934): n is a, c, t, g, unknown, or other
  misc_feature (935)..(935): n is a, c, t, g, unknown, or other
  misc_feature (969)..(969): n is a, c, t, g, unknown, or other
  misc_feature (970)..(970): n is a, c, t, g, unknown, or other
  misc_feature (983)..(983): n is a, c, t, g, unknown, or other
aacaccatcacccacggaaaacaacgcacacaccaacacaaacaaaaaaaaaagaaaaatcgnaanggnnnggannannnnnnnaaaaaactggtactcaccgcggtggcggccgctctagaatagtggatcccccgggctgcaggaattcgtctcacccctagaaaacctcctcctcatctcactcactcccttttcctcacgccccctccccgcctcgagcccctcgctggctcgctcccattcccatctcgcaccaccaaccttccggatccagtgccgcacgcctcactccccgtccccgacacccatgacacgcaagaggcgcaagcacgccgccgccaccgccgcctagggttccgatcccttcctcatggattcgctgccgcgtaagcgcaagggcgcgcgcgccgcngtgctccatggnccgggatccccgccacggatgccgccctggcccgcccccggccaaaagcgccccaccctgggccccccgaaaggccccaaaggccgcgggggccccgggtgaaacacaaaaaaaaaaccccccnnnttttttttccccccccaaaaaaaaaaagaggggggggttttttaagggaggtttttttttttgcggcccccccccccagtaattaatatacagagagggaatatggttgtggtgtttttttttgtttccaatatttattattaatataaaagactaagcgggcggggggggggatntacatnntttattgcggctagctgttcggacgaaattaagagtaattgttaccataaataaactatgaacgcgagcgctgctagactagatacgtgcgaggtaggaagaggagtangcgatgatgatcgtaagagnnngnttnnnnnnnnntntncacgagttgatgagacgccgnagatactcagccaagnggccgaaacgagnnaaataagtaaaaccataacacaatgactacacgnncccctgagacggncggatagtaaaaagggttataaatagacgtctgttagtgaacaggtaggaagctatggcgctcctatct

SEQ ID NO: 89439 - DNA, 1012 bp, Zea mays
  misc_feature: Ceres CLONE 1577097
  misc_feature: Encodes the peptide sequence at SEQ ID NO. 89440
atagctggagctccccgcggtggcggccgctctagaactagtggatcccccgggctgcaggaattcgtctcacccctagaaaaagcgagcagcccggcgtatgccccccaaaccctcgcaccctaaaacagcggcgcacaagatgtccgactaccccaccaacggcggcggctgtgatcccgtggcaggacgtcgtccgcaccgagggtgaaacacaacctcgtaatgatggcttgtcgaaatccaaggatagggacaaagatagagaaaatgacaaggacagacatcgtctcatacaaggtgacacagatcgagggagagacatggaccgtgatttggacagggacagggatcgggacagagacgaggatggacaaagtaggcatcaccatcaaagacgggaacagcgagtaccgtcctgatgatcacagagtccgtgattctgaaagaagaagagaacgcagcacacatgggcatcgtatgcagcgttctctgtctcgttcaaggggtacagatccaagatctaagtcacgttcgataagcaagcaagttaatggattctatgcgccaacccagctagcaatgggttcaacatgtccaggtattccaaccccaagaaaacatgtttggtaacaaagccaatctgggggcacttgcctcacttctaccaggggcaataagctgactactatagctttaatgttcaaggaaaaatcaactgcccctgttttgtatccgtcagggcccccttcaaactaactagtaccatggttacttcgttcacttaggattaccaatttcccttttggtccttgcccaatattttgataaaaacctctgccaagaatccaaggataaccttgggttttgtcaccaaaagcggccctttatgggggttttatgtaagatggcgtacacttttgcaaaattgtgatttgggcggaacaaccagaaaattatactgttggaacagggtgaggtaaatgtgttccgagagcacctttcttcttgg

SEQ ID NO: 89440 - protein, 135 aa, Zea mays
  misc_feature: Ceres CLONE 1577097
MMACRNPRIGTKIEKMTRTDIVSYKVTQIEGETWTVIWTGTGIGTETRMDKVGITIKDGNSEYRPDDHRVRDSERRRERSTHGHRMQRSLSRSRGTDPRSKSRSISKQVNGFYAPTQLAMGSTCPGIPTPRKHVW

SEQ ID NO: 89441 - DNA, 1099 bp, Zea mays
  misc_feature: Ceres CLONE 1577098
  misc_feature (22)..(22): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (666)..(666): n is a, c, t, g, unknown, or other
  misc_feature (667)..(667): n is a, c, t, g, unknown, or other
  misc_feature (674)..(674): n is a, c, t, g, unknown, or other
  misc_feature (675)..(675): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (693)..(693): n is a, c, t, g, unknown, or other
  misc_feature (694)..(694): n is a, c, t, g, unknown, or other
  misc_feature (704)..(704): n is a, c, t, g, unknown, or other
  misc_feature (705)..(705): n is a, c, t, g, unknown, or other
  misc_feature (708)..(708): n is a, c, t, g, unknown, or other
  misc_feature (709)..(709): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (810)..(810): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (998)..(998): n is a, c, t, g, unknown, or other
  misc_feature (1099)..(1099): n is a, c, t, g, unknown, or other
tgtgggtggttggggggggctnccntanntnttttaggggtggggggtgtgaatttacatttggggggggggggcaaactggagctccccgcggtggcggccgctctagaatagtggatcccccgggctgcaggaattcgtctcacccctagaaaaaactcctttgcattggagtagcagcaaagcagctcggccagccagccagtgggtctgttccggaggcacacacgcacagttgctgctgaagcacacggcagttgccttgcctgttcgattgctgcttccttcctcctccctcgagtcttcttctcagcccagagaggaacagtacgcccaaaggggaagaggctgggtaagggggccgcttgctctgccccgatccaaccaagccaaggcaagcacagcagcgggtacgttcctctcgggcctgcctggaatgggaaacaaaaaacggcccaacccggccggggccccccccaaaaaatatttcttggggtgttcccggggggggcccccccccttttggggggggggttcttttggggggggcccacaaaaacctagggagggccccccggggggccccgggggtaaatatcgcgggggggggaacaaaacaaggcatattttatagggggggttcccgccggctttttttttttgggnngcccccnnccnnnnnnnnnnnggggnnccttggttgnnccnnttgggcagcgnnnnnnnnnnnnnnnnnnnnnnncctccgcctggccgcgaaannnnnnnntnnnnnnnnnnnnnnnnnnnnngtggagaggaagagccccntctttnnnnnnnnnnnnngggagggggaggaaaaagagggggaattnnnctgtgtctttgttatatttacttaagggaagagatgtgggcgtggcggtgagatttattttttggggcggtctccctcacttgccgggggggggttggagtattcacaaagggggaggtcctcccctcaataccaaaancccccccccccccccttttttgtggggagaaatagagacaacccccccccccacaccaataacaagtggggtgtggggtggggtgcgcgtaatacaaaaan

SEQ ID NO: 89442 - DNA, 856 bp, Zea mays
  misc_feature: Ceres CLONE 1577105
  misc_feature: Encodes the peptide sequence at SEQ ID NO. 89443
  misc_feature (690)..(690): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
ggagctccccgcggtggcggccgctctagaactagtggatcccccgggctgcaggaattcgtctcacccctagaaaaagcgggtctcctcgcccagcggactcctactctgctgcgctccgctccgttccgttccgctcccttcctcgcggcagcaatcgaatgtctcccgacgtagacgccgccgtggcaaccgccgtcgctgccgggggaggctgcggcggtgacggagaggcgggcggtggcgcgtcgtcgtccccggcgtccgcggcggcggcgaacgggcgggcgttggtgcggtgggatcagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgggagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaacagtgagaaagaatgaactgcgtaacttatggcaacatgtgtgggagcnggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 89443 - protein, 161 aa, Zea mays
  misc_feature: Ceres CLONE 1577105
  misc_feature (56)..(161): Pfam Name: Response_reg Pfam Description: Response regulator receiver domain
  misc_feature: SWISSPROT Homolog: EC 3.1.4.17 3',5'-cyclic-nucleotide phosphodiesterase
MSPDVDAAVATAVAAGGGCGGDGEAGGGASSSPASAAAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQKGAVDFLVKQ

SEQ ID NO: 89444 - DNA, 792 bp, Zea mays
  misc_feature: Ceres CLONE 1577108
  misc_feature: Encodes the peptide sequence at SEQ ID NO. 89445
  misc_feature (727)..(727): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
ctccccgcggtggcggccgctctagaactagtggatcccccgggctgcaggaattcgtctcacccctagaaaaagtgctcccatggaatcggcggcgattgggtcgcagtccccgctctccttcccctccaacctctgcgaatcaaaagtatcctctggtttaccaatatacaatgtgaagatcaagggcaatcataggcttgacgtggtgtgccgtgggatgtttctacaagaaagtttatgcaaaggaaaaagaaagaagttttcaaggacgctgatgacgaggccgagcagatgaattggaggagaatgatgagagagatagaggaggcgggatcagctgtacgtacccattctgaagacccagcgaagcgggaaagagccacttccaagggatgctattcttgggactcttgtgcggttcaaacaattgaaaaaatgggatattgtcagtgagattcttgaatggctcagaacacagcattggtggaacttcagtgagatggacttcttgatgcttgtgacagcttatgggaagttgggggattttagcacggcagaaagggtcctcaagtacatgaaaaaaaaggttaacagccatgcgtcatgtcaaaactggtctgatggaggcgtatggaagagggaccgaattttttgtattttagcccttaaacagaagtaaaatcacgtttagacctaaaaaattttaatgattggcccccccttngtttcgggggggcggttttttttttttgggggccnnnnnttaaaaaaaatcccgggccgaaaacc

SEQ ID NO: 89445 - protein, 71 aa, Zea mays
  misc_feature: Ceres CLONE 1577108
MESAAIGSQSPLSFPSNLCESKVSSGLPIYNVKIKGNHRLDVVCRGMFLQESLCKGKRKKFSRTLMTRPSR

SEQ ID NO: 89446 - DNA, 799 bp, Zea mays
  misc_feature: Ceres CLONE 1577116
  misc_feature: Encodes the peptide sequence at SEQ ID NO. 89447
  misc_feature (727)..(727): n is a, c, t, g, unknown, or other
  misc_feature (770)..(770): n is a, c, t, g, unknown, or other
  misc_feature (786)..(786): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctaaaaaaaaagatcgttgcacaccgctcggaagagaaatgattgccacgaccggcggcagctcggcgaaggcggcggcggcggtgggcggcaaggcggcgcgcgcctgtgacgggtgcctgcggcggcgggcgaggtggtactgcgcggcggacgacgcgttcctgtgccaagggtgcgacacgtcggtgcactcggcgaacccgctcgcgcggcggcacgagcggctgcgcctgtgcccggcgtctccgctgcagacgccgccagctcgctcggcggcggcggcagcgacggcgactaataagcgcgagcgtcacgacgaggtggcggtgcccgcgtggttcgggcgcaaggcgcgaaccccgcgcggcgggcacgccaaaagcgtcgggcaggtggcgttgtcgcggcgcctcgtcgtaccgcatgcggctggcggggactcagactcacccgatgagcgaaacggcggcgaggaggagcagctgctctaccgcgtgcccatcctcgaccccgccctagccgagttctgctcgcccccgcctctcgaggacgcgggccggtctcgcgtcggtgtgcaacgaagacggcgccatcgagaacccgcgaaagcggatcctgcagcgccgctggcccagttctgccccgtcgggcggcatttngacttcggcccgaccgacgccgagctcagggagttcgccgcgnacatggaagccctccntcggcacggnctg

SEQ ID NO: 89447 - protein, 232 aa, Zea mays
  misc_feature: Ceres CLONE 1577116
  misc_feature (19)..(66): Pfam Name: zf-B_box Pfam Description: B-box zinc finger
  misc_feature (208)..(208): Xaa is any aa, unknown, or other
  misc_feature (223)..(223): Xaa is any aa, unknown, or other
  misc_feature (228)..(228): Xaa is any aa, unknown, or other
MIATTGGSSAKAAAAVGGKAARACDGCLRRRARWYCAADDAFLCQGCDTSVHSANPLARRHERLRLCPASPLQTPPARSAAAAATATNKRERHDEVAVPAWFGRKARTPRGGHAKSVGQVALSRRLVVPHAAGGDSDSPDERNGGEEEQLLYRVPILDPALAEFCSPPPLEDAGRSRVGVQRRRRHREPAKADPAAPLAQFCPVGRHXDFGPTDAELREFAAXMEALXRHGL

SEQ ID NO: 89448 - DNA, 964 bp, Zea mays
  misc_feature: Ceres CLONE 1577118
  misc_feature: Encodes the peptide sequence at SEQ ID NO. 89449
ctggagctccccgcggtggcggccgctctagaactagtggatcccccgggctgcaggaattcgtctcacccctagaaaaagccttcaactccactccctcgctctctcgggccttcttccctagcggcgacgacggggtgatcactgattcactgccgcccgcgccaggtcggccagaactagtgggcgccaaacatcatagcgatcatggaggtggtctcttgcagccactcctgctcggcattacatcaaacaccagcaagcacatggaggcttcggggcagtgctcttggccttggtcttgggcatgccaggccttcccggaccagaagatacacagttgcgtgtgtaggaaccacgagtggagcttcgaatccgggtggttccggcaaggtccatgcagcccagggattccatgtaagcgacgtggatgcagccctgcagggcattccttccatgaaagccggggaggccgagagggtgatgattcaaggccttccggaaggccctgacagctccccgatcagtactgggttctgggagtggaagccgaagctgactgtgtactacgagaggtccggcatgaagaacagcaaggcacctgcggtgctcttcctgccggggttcggagtcgggacgttccatttcgagaagcagctgagggatcttggtcgcgatcatcgggtgtggacgatggattttctcgggcaggggatgtcgctgcctggtgaagatcctgctcctagtagcatagcgagcgaagatgcgttttggggctttggacagaatcgcagccctgggcagaagagctggtgtatcctgtggatttatggcaaacccagttcacatttcattggagaagttatccgtgaaccagttaatatgttgggaacccccttggagttttggtgctccgtatttgccggccccagccacacctggaaaagggtccccggcttatgcc

SEQ ID NO: 89449 - protein, 252 aa, Zea mays
  misc_feature: Ceres CLONE 1577118
MEVVSCSHSCSALHQTPASTWRLRGSALGLGLGHARPSRTRRYTVACVGTTSGASNPGGSGKVHAAQGFHVSDVDAALQGIPSMKAGEAERVMIQGLPEGPDSSPISTGFWEWKPKLTVYYERSGMKNSKAPAVLFLPGFGVGTFHFEKQLRDLGRDHRVWTMDFLGQGMSLPGEDPAPSSIASEDAFWGFGQNRSPGQKSWCILWIYGKPSSHFIGEVIREPVNMLGTPLEFWCSVFAGPSHTWKRVPGLC

SEQ ID NO: 89450 - DNA, 792 bp, Zea mays
  misc_feature: Ceres CLONE 1577120
  misc_feature: Encodes the peptide sequence at SEQ ID NO. 89451
ggagctccccgcggtggcggccgctctagaactagtggatcccccgggctgcaggaattcgtctcacccctagaaaaaccaagaagagcagcaccatcaccagatcttctccatcaagagtaacaggccatcgccttactagttctgatcccaaatcatttacggcgtaggtgcctcttgctcagaacccagccccacagcaatagagtgcaagaacggccgcatagctgcaaccaacagcgattccctgtgcatggcgacaccccgcgacgaccctcttaactgggggaaggcggctgaggagctgatgggcagccacctggacaaggtcaagcggatggtggccgagtaccgccaacccttggatgaagatcgagggcgccagcctcaacatcgcgcaggtggccgccgtggccaccggcgctggcgaggcccgggtcgagctggacaagtctgcccgtaaccgggtcaaggcaagcagccactgggtcatgagcaccatgatgaacggcaccgacagctacggcgtcaccaccggcttcggagccacatcgcacatgatgaccaatgagggcggcgcgctccacagggagctaatcatgttcctcaacgcctgcgccttcggcaccggcgctgacggccacgtgctgccagccgaggcgactcgcgcagccatgctagtccgaatcaacagcctccctcaggggtactccggcatccgcttcgagatcctagaggcgatcgtcaaactgctcaactccaacgtcacgccgtgcactacggatcgcggca

SEQ ID NO: 89451 - protein, 142 aa, Zea mays
  misc_feature: Ceres CLONE 1577120
  misc_feature: SWISSPROT Homolog: EC 4.3.1.5 Phenylalanine ammonia-lyase
MKIEGASLNIAQVAAVATGAGEARVELDKSARNRVKASSHWVMSTMMNGTDSYGVTTGFGATSHMMTNEGGALHRELIMFLNACAFGTGADGHVLPAEATRAAMLVRINSLPQGYSGIRFEILEAIVKLLNSNVTPCTTDRG

SEQ ID NO: 89452 - DNA, 807 bp, Zea mays
  misc_feature: Ceres CLONE 1577121
  misc_feature: Encodes the peptide sequence at SEQ ID NO. 89453
ctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacagcggtctgctccagctcaccgccgtcgacggccgccgcgccaccgtcgtcgtccccaacgaccccgtactcatagacatcctcgccaccaacggcgtcgacatctccgtctccgagggcgagtcggcgggcccgggcggcttcgtcgccttcgtcggcaacctcctcttcccttttatcgcgttcgctggccctcttcttcctctttccgccggcgcagggcggggcccggcgccggggcctggtggccctcgggggggcccatggaacttccgccgcc

SEQ ID NO: 89453 - protein, 220 aa, Zea mays
  misc_feature: Ceres CLONE 1577121
  misc_feature (103)..(209): Pfam Name: FtsH_ext Pfam Description: FtsH Extracellular
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDSGLLQLTAVDGRRATVVVPNDPVLIDILATNGVDISVSEGESAGPGGFVAFVGNLLFPFIAFAGPLLPLSAGAGRGPAPGPGGPRGGPWNFRR

SEQ ID NO: 89454 - DNA, 813 bp, Zea mays
  misc_feature: Ceres CLONE 1577122
  misc_feature: Encodes the peptide sequence at SEQ ID NO. 89455
ctggagctccccgcggtggcggccgctctagaactagtggatcccccgggctgcaggaattcgtctcacccctagaaaaactagcttgccgcgccgcctggatcgatcagccgagcgactaagcgaagactcccttttccccgagcacaagagaaccatggcggcggcggcagtatacggcggcttcaaggggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcactactcgcaagtccccttgcggtgaaggacaaacacatggggatcggtttgagttccgcattcacaagaggggtgattgaccctaatcagctcccctgatgtgggtgaagcagatcaccctccatcaccaatggagccccggttgttgagggtttaagtgaccattggcccacctgttagggacttgaaagttcacccaaaggtccttccaacaaacccttttttctttggggcccccccgggggggctcccgcaaagagaaatttttgaggtttttttttgggcgtatcaggaaattttctttccccccctaaaaaattccttggttaaaccggtgtttgcccgaaaatataggggcccggtttcacattttgaaaatttttggtcttcgggaaacttttttagggggggggggaaaattagaaaatttgggagccccccccca

SEQ ID NO: 89455 - protein, 96 aa, Zea mays
  misc_feature: Ceres CLONE 1577122
  misc_feature (26)..(97): Pfam Name: Ribosomal_S10 Pfam Description: Ribosomal protein S10p/S20e
MAAAAVYGGFKGKLGVEDAPELQLNRIRITLSSKNVKNLEKVCADLVKGAKDKHLRVKGPVRIPTKVLHITTRKSPCGEGQTHGDRFEFRIHKRGD

SEQ ID NO: 89456 - DNA, 1199 bp, Zea mays
  misc_feature: Ceres CLONE 1577125
  misc_feature: Encodes the peptide sequence at SEQ ID NO. 89457
gaaggaagatgttgttatctaccccccccaccacaggcggagacccgctttctaaggggggggcccgagcaaaactggagctcaccgcggtggcggccgctctagaactagtggatcccccgggctgcaggaattcgtctcacccctagaaaaagcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccatacgcgcagcgcgcttggattgccaggaactacaagggtttgcaggacaagattaagatagtcgccatcgatcttgctgacaggccaacatggtacaaggagaaggtttatccagaaaacaagggtgccttctctggagcacaacaaccaggtgaaaaggtgagaaggtttggatctgggtcaagtacattgacaggaactttggaaagggccttcgtttgctcccaaaaagggatccctttcaaaaaaagcaagttccgctggaaggaagctggcttggcataattccttggatggcgttttgagagaaaggcgttttcgacccttttttggtcgaaagccctcccaaagggaaagaaaggttgtccttggaaaggaaaagaccttggtccgctcttgcctcttttggggactagaaaaatattagtaaagagaaagtgccgcgctctatcgaggggtgagaaaatttgtcacagacgcgagagggggggggttcctcaaagttactcatttcgcccctggtgtggtggacgcaaagtgttttacgaaaagacccgtgagggagggggaggacacatatttgaacgcgtgtgtggttgtacagcccgagataggcacatacggggggaggggggtgtattctggaaaaaaggatgcgcgaatgttgcccaacgccttatagatacacaactttggtgggaataatgttcgccagaggggggggatgaataccccaaaaccatttgagaagaaagggtcccaaggtgaagggtgatagtgcgtcacagcagattttgtgaggcgggcgacgagcgcgagagtttaaagacagggtggacccccggagtgttttgtaatatgtgggccgcaccacaaaaaaagtgggg

SEQ ID NO: 89457 - protein, 135 aa, Zea mays
  misc_feature: Ceres CLONE 1577125
  misc_feature: SWISSPROT Homolog: EC 2.5.1.18 Glutathione transferase
MAAAAPASSVKEVLPSPLTSASEPPPLFDGTTRLYVAYHCPYAQRAWIARNYKGLQDKIKIVAIDLADRPTWYKEKVYPENKGAFSGAQQPGEKVRRFGSGSSTLTGTLERAFVCSQKGIPFKKSKFRWKEAGLA

SEQ ID NO: 89458 - DNA, 1215 bp, Zea mays
  misc_feature: Ceres CLONE 1577128
  misc_feature: Encodes the peptide sequence at SEQ ID NO. 89459
  misc_feature (68)..(68): n is a, c, t, g, unknown, or other
  misc_feature (69)..(69): n is a, c, t, g, unknown, or other
aaaatgaagaaggtgggccctcccctgccgcgccgaggggacaggtatattaaaaaacgggtggaggnnaaaaactggagctccccgcggtggcggccgctctagaactagtggatcccccgggctgcaggaattcgtctcacccctagaaaaaaccaaaaacccttccgccccgagccgaccggaaccctacccatcccgcagcgccgccggccgcccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaagaaagttgagagcagcagctctgaggaggattcttcagattccgaaagtggaggttaaggtccagcccgaagaagggttattcaaccgaaagagaggggacacaaaccctgctaaaacaggaagtcccaagtgaatggacagccaggcttcttgaagaacctcccctccagaacgaatggaaacccctgtcccaaaaaaaaaaccaaggttttgtccgggggtattcaaaaaaaaaaaagccctttcccctgggcccacagagttaaggttaaagccccaacccccaggttggggaaatgggaaaataggggcccacagtgtgggaaaaccaaggggggggaaatgggaaaaaaatggggtaacagcctctcttcttggggaatgtggaaaggggaaaatcaccccgcccctgataaaggacagaagccgcccccacgcggggggtctcctttttttctccaaaaggagaaaaagcccccacacctctggtttcccttttttgttaagaaacaaaaaaacacccggggataacacaaaggcaagactcaacgtataaaaggggggttgcaaaaaaaaacacggggtttaaaaacccctggatataatccaaaccagagccttcttggaaaagggacagcctcccgcaaactgcagggaagtaaaaagaaaacctcggcggggttcttgcctctaaacagaacaccctgttttggttgcgccctcctgggagcaaaaag

SEQ ID NO: 89459 - protein, 80 aa, Zea mays
  misc_feature: Ceres CLONE 1577128
MGKSSKKSSVKAAPAAVSVPEVKSAKKGKRNAEDEIEKAVSAKKQKTVPEKAVPVKKQPPPKKVESSSSEEDSSDSESGG

SEQ ID NO: 89460 - DNA, 985 bp, Zea mays
  misc_feature: Ceres CLONE 1577129
  misc_feature: Encodes the peptide sequence at SEQ ID NO. 89461
  misc_feature (805)..(805): n is a, c, t, g, unknown, or other
  misc_feature (850)..(850): n is a, c, t, g, unknown, or other
  misc_feature (851)..(851): n is a, c, t, g, unknown, or other
  misc_feature (859)..(859): n is a, c, t, g, unknown, or other
  misc_feature (976)..(976): n is a, c, t, g, unknown, or other
tggagctccccgcggtggcggccgctctagaactagtggatcccccgggctgcaggaattcgtctcacccctagaaaaaaaggccaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacaaggacgcttccgttgacaataaaaatctaacagttgatgttgagactatgaggagaaaggttcgttcgtcttgaatgcatcacagacctttttcttcttttttttgttgtacgagaactcttaactgcatccatttatcgatcataacatttttactggggctctgtgtatactcaccgtaatcaacgtttacatnctctctagatgggctgcaagggcagtgaaagtaaatatgattgtnncatagtcntattttagaacctgcaaggtcagttttagtttcctaatgggtttaaactgcacacaaaggtatggcagccatttcatttgattttctgaaatctgcaaaacctctacagggggaaangattatttt

SEQ ID NO: 89461 - protein, 74 aa, Zea mays
  misc_feature: Ceres CLONE 1577129
  misc_feature (2)..(58): Pfam Name: bZIP_1 Pfam Description: bZIP transcription factor
MRRMVSNRESARRSRKRKQAHLTDLESQVSRLTSENASLLKRLADMTQKYKDASVDNKNLTVDVETMRRKVRSS

SEQ ID NO: 89462 - DNA, 810 bp, Zea mays
  misc_feature: Ceres CLONE 1577130
  misc_feature: Encodes the peptide sequence at SEQ ID NO. 89463
  misc_feature (334)..(334): n is a, c, t, g, unknown, or other
ggagctccccgcggtggcggccgctctagaactagtggatcccccgggctgcaggaattcgtctcacccctagaaaaaacaccaacccagccatggccaaggcagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagagggntaagggggagaaccccatgatgacacccctgccctacatcatcatcttcggcatgtccacccccttcgtcatcctcgccatcgccttcaccaatggctggatcaaggtccctgtgcgatgaccgtaacgcgatcagccagcctggatcatagatgctgactcgtcagcctgcatctcatccagcgtgtgtcctgcgactttgtaccttcatatatagagacaagagttcttgcgtgtgagcataattgcatgatcgcgtggtgtatgtaacccgaaactgtttaccttttcgcaacaacttcaatcttcactcttcaaaaaaaagcacgccccaaccactcgacgtcaatccccctctattggcggcacccagtccccacctgttgcacgcgatcccttcggcacaccgcctcttagcgcagatttgttcgcccctcgccctcttcagacttggtgattcacagagtcggccagcg

SEQ ID NO: 89463 - protein, 120 aa, Zea mays
  misc_feature: Ceres CLONE 1577130
  misc_feature (81)..(81): Xaa is any aa, unknown, or other
MAKAAPPLLAAGSRTAITAQQPSSRKGAAGTGLFCSRAIVSKRTRVTAKLGDGELKPAGKRKFITKEEEPEQYWQTAGERXKGENPMMTPLPYIIIFGMSTPFVILAIAFTNGWIKVPVR

SEQ ID NO: 89464 - DNA, 849 bp, Zea mays
  misc_feature: Ceres CLONE 1577131
  misc_feature: Encodes the peptide sequence at SEQ ID NO. 89465
  misc_feature (725)..(725): n is a, c, t, g, unknown, or other
ctggagctccccgcggtggcggccgctctagaactagtggatcccccgggctgcaggaattcgtctcacccctagaaaaaagcccgtgccgtggcgcgtggtgggattggcggcaaagcaagcgggggcgatcggagagagagatgggagaaattacgcgtcgatcagcagcagccgccgcaaccagcagcccgcccaaccctacccgcgcgcccgtccccctccccgtcctcgcccgcgtcatcgacccggcacccccttctcgtcttcccctccacctcgtcacgccgcacgagcccggcccaaataccctcgcgctcccacctctcgcactccacaaaccctaaccctagctcgctgccgccaccggtcccctatagtccgtgtttgccgccgcagttgctggcagcggagttggctggcacggaggtcacttggtctggagttaagtgcgtgttgtaatggaggggctcaacgccactgatgctgtgatcaagaagccaaggagtgttgcattcaggaagccaaggtccatgaagcagctcacggttgagtgcaatggcatttgcctgccatctcggagtgcttgtcatgacgatgacactggcatcgaaagtggtgggcagcggaggaaagagctacacctaaatagcccctgaatgaagggctccatgactcataggagtgacgtgcccagtaaagatagaagggatgataaatctggnaggtgaccatgaatgttcatggtcagagcagaaaaaccaaggatgcccgccaagcatgggaagtggaaagggttcttgcccctgggagtggcccgcaaggaaactttgaattccctttgaaaat

SEQ ID NO: 89465 - protein, 65 aa, Zea mays
  misc_feature: Ceres CLONE 1577131
MEGLNATDAVIKKPRSVAFRKPRSMKQLTVECNGICLPSRSACHDDDTGIESGGQRRKELHLNSP

SEQ ID NO: 89466 - DNA, 904 bp, Zea mays
  misc_feature: Ceres CLONE 1577135
  misc_feature: Translation starting site: 124
  misc_feature (707)..(707): n is a, c, t, g, unknown, or other
  misc_feature (708)..(708): n is a, c, t, g, unknown, or other
  misc_feature (741)..(741): n is a, c, t, g, unknown, or other
  misc_feature (746)..(746): n is a, c, t, g, unknown, or other
  misc_feature (795)..(795): n is a, c, t, g, unknown, or other
  misc_feature (805)..(805): n is a, c, t, g, unknown, or other
tggagctccccgcggtggcggccgctctagaactagtggatcccccgggctgcaggaattcgtctcacccctagaaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcgcagctcttatgaactcgacaagctcctagatacagcagcttcaggaggcatttgctgagcttgagagccagagcacggtttccagtgaccctcagtggaagcagcttgaagaccacttcgtggtcnntgacagtccctcagaaaaagttgacgagctaangagcnggagaaggagttccaggagacggtcgcaaatcagagcaattctggacancgggaggcanctgttttggcaaagaactgacccccctgggaaaattgcgggaaaaaagggacctgccttacctttgaattttagaaaggcaaggttctccttactgttc

SEQ ID NO: 89467 - DNA, 854 bp, Zea mays
  misc_feature: Ceres CLONE 1577136
  misc_feature: Encodes the peptide sequence at SEQ ID NO. 89468
  misc_feature (829)..(829): n is a, c, t, g, unknown, or other
ctccccgcggtggcggccgctctagaactagtggatcccccgggctgcaggaattcgtctcacccctagaaaaaatgacctgtgctgcatggcatgcacttgtatttcttgtgcctgcttaagtgcttattgctgggctatccgccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcatccatctctacttgttttcctcacatgtacaacaattaatgcaacaaattaagtacgtacttgagagagagancccttcttctctttttcttttttta

SEQ ID NO: 89468 - protein, 155 aa, Zea mays
  misc_feature: Ceres CLONE 1577136
  misc_feature (59)..(155): Pfam Name: Copper-bind Pfam Description: Copper binding proteins, plastocyanin/azurin family
MASLSSAAITAPSFTAAPARAVVSRRSFTVRASLRKATATAAVAVAASVLLAGGGAMAQEVLLGAGDGGLVFEPSQFTVKAGDTITFKNNAGFPHNVVFDEDEVPSGVDASKISQEEYLNAPGETYSVTLTVPGTYGFYCEPHQGAGMVGKITVN

SEQ ID NO: 89469 - DNA, 932 bp, Zea mays
  misc_feature: Ceres CLONE 1577147
  misc_feature: Encodes the peptide sequence at SEQ ID NO. 89470
  misc_feature (704)..(704): n is a, c, t, g, unknown, or other
  misc_feature (800)..(800): n is a, c, t, g, unknown, or other
  misc_feature (830)..(830): n is a, c, t, g, unknown, or other
  misc_feature (932)..(932): n is a, c, t, g, unknown, or other
ctggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttnccttttatcgcgttcgctggcctcttcttcctcttccgccgcgcgcaaggcgggcccggcgccgggcctggtggcctcggcgggcccatggacttngccgctccagagcaaagtccaggagtgccntgagacggtgtcaccttcctcgacgtgccggcgcggacaggcaagctcgagctgcaggagtcgtcgatttctcaggaccccgacagacacgggctcgagccn

SEQ ID NO: 89470 - protein, 226 aa, Zea mays
  misc_feature: Ceres CLONE 1577147
  misc_feature (103)..(225): Pfam Name: FtsH_ext Pfam Description: FtsH Extracellular
  misc_feature (184)..(184): Xaa is any aa, unknown, or other
  misc_feature (216)..(216): Xaa is any aa, unknown, or other
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLXPFIAFAGLFFLFRRAQGGPGAGPGGLGGPMDXAAPEQSPGVP

SEQ ID NO: 89471 - DNA, 809 bp, Zea mays
  misc_feature: Ceres CLONE 1577156
  misc_feature: Encodes the peptide sequence at SEQ ID NO. 89472
ctccccgcggtggcggccgctctagaactagtggatcccccgggctgcaggaattcgtctcacccctagaaaaaattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttggctgcagatctggaagggtttcgtgggatccgtcgctacgatctgtcccagtcagagcatctgcatcatctcgggttgggccatggagactctgctcatctcggaggagcgcaaccaccagctccaccacttctcgggtcgccgtaagaaggcgttagcagcgtcgcctcagtccacgcgcagctaccatgcgggcaactgccgggcgttccactccggcatcacggtcggcatcctgccgtccccgcccgcgcagagggttgcactgacccgctcctctcctgagcccaagacaccgaaacatcagcttcaccatgggaaaaagcgcagccgagcaatctctatgaaccttttcgacgttccctccctctcggccctgagctcttgggctgggcccggggtttctgcaaatttgccggcttcccaggtttcttcccggatccccaagtt

SEQ ID NO: 89472 - protein, 122 aa, Zea mays
  misc_feature: Ceres CLONE 1577156
METLLISEERNHQLHHFSGRRKKALAASPQSTRSYHAGNCRAFHSGITVGILPSPPAQRVALTRSSPEPKTPKHQLHHGKKRSRAISMNLFDVPSLSALSSWAGPGVSANLPASQVSSRIPK

SEQ ID NO: 89473 - DNA, 971 bp, Zea mays
  misc_feature: Ceres CLONE 1577158
  misc_feature: Encodes the peptide sequence at SEQ ID NO. 89474
  misc_feature (285)..(285): n is a, c, t, g, unknown, or other
  misc_feature (627)..(627): n is a, c, t, g, unknown, or other
  misc_feature (712)..(712): n is a, c, t, g, unknown, or other
  misc_feature (713)..(713): n is a, c, t, g, unknown, or other
  misc_feature (747)..(747): n is a, c, t, g, unknown, or other
  misc_feature (772)..(772): n is a, c, t, g, unknown, or other
  misc_feature (773)..(773): n is a, c, t, g, unknown, or other
  misc_feature (785)..(785): n is a, c, t, g, unknown, or other
  misc_feature (813)..(813): n is a, c, t, g, unknown, or other
  misc_feature (874)..(874): n is a, c, t, g, unknown, or other
  misc_feature (892)..(892): n is a, c, t, g, unknown, or other
  misc_feature (938)..(938): n is a, c, t, g, unknown, or other
ctccccgcggtggcggccgctctagaactagtggatcccccgggctgcaggaattcgtctcacccctagaaaaatccggcctcatccgctgctttcctcgcaactatcggatcttgcgaaggcatcatcctcctatcctataatcgcatttcgaatcgcaaacggagacttcgcccctcttcacagattctaatcgaatttgccaatctgcaagctaacgtagtgattttctgtggtggtggtgatgtgcgatcgcaggaacaatcaccaatcaccatccttaanaagatgatgcgatgcactgtaacgagcggcgggtgcgttgcttcctggattggtgatcggaggtcgccggctgtgcaccccttcagcgtgcggatgtcgacgggcaacggtgggtggtggggggggcttatgtcgcggggggcggatctctccggcctcgagaaggcgcatcttcatgggggcatcagggggggctttcccggcaacccccccctatgggggcctggagggccaggggcgcagttgaccctgaaaatattcccccggggaaagggccagggataatccgcgaggagggggggggcgcagaagttagggggtggatctgttgggggggggggnttggtaatggggtatctccatagggggagagcaaatggagcgcccataaataatttgtgggaagagaactggagaaagtactggnnaaccgcccgcctctcgggggaggggggggtgagnaaagtcccctcctgggggggcgccnntggcggtcattngcgggggggacgagtggggagaaaaaantcagccgggaaaaaatatatattgcgggttatgacccccccccgagaggggaggagccgtnttaggaacgaaacaaaangaatttagtctgacaagaaaagtgcagagcgcgctgtagaaagaanaacgtggtatactctgtcgggcggagacgacaa

SEQ ID NO: 89474 - protein, 93 aa, Zea mays
  misc_feature: Ceres CLONE 1577158
MMRCTVTSGGCVASWIGDRRSPAVHPFSVRMSTGNGGWWGGLMSRGADLSGLEKAHLHGGIRGGFPGNPPLWGPGGPGAQLTLKIFPRGKGQG

SEQ ID NO: 89475 - DNA, 785 bp, Zea mays
  misc_feature: Ceres CLONE 1577160
  misc_feature: Encodes the peptide sequence at SEQ ID NO. 89476
  misc_feature (771)..(771): n is a, c, t, g, unknown, or other
acccgcggtggcggccgctctagaactagtggatcccccgggctgcaggaattcgtctcacccctagaaaaaaagcgggtggtagaggttgttttggaagggaaagagaggagacagggtccaaacgaaccgaaacggaccagtacaggcacagccgcacaggcacagacaggctgcggggaacggaatggacgagcggcggaggaggacgaagcgggaggaggcggacggcgagtggcggcgctgggcggtgctggtggcgtcggtgtggatccaggcgctgacgggcaccaacttcgacttctcggcctactcgtcggcgctcaagtcggcgctgggcgtgtcgcaggtggcgctcaactacctggcgacggcgtcggacctgggcaaggcgctgggctggtcctcggggctggcgctgctgcacatgccgctgcacgccgtgctgctggcgtcggccgcgctggggctcgccgcctacgccgcgcagtactactgcctcgtgttcgtcagcccggccgccctcgccgccgtcccataccctctggtgttcctggtctgcctggtggcggggtgcagcatctgctggttcaacacggtgtgcttcgtcctctgtatccgcagcttctccacgagcaaccgctccctggccctctcgctctcgataagcttcaacgggctcagcgccgccttctacgcgctcttcgcaaacgccatctcacccttcaccccaaccatctacctcctcctcaacgcggtcctccctctcgncgtctccgtcctca

SEQ ID NO: 89476 - protein, 199 aa, Zea mays
  misc_feature: Ceres CLONE 1577160
  misc_feature (19)..(199): Pfam Name: Nodulin-like Pfam Description: Nodulin-like
  misc_feature (195)..(195): Xaa is any aa, unknown, or other
MDERRRRTKREEADGEWRRWAVLVASVWIQALTGTNFDFSAYSSALKSALGVSQVALNYLATASDLGKALGWSSGLALLHMPLHAVLLASAALGLAAYAAQYYCLVFVSPAALAAVPYPLVFLVCLVAGCSICWFNTVCFVLCIRSFSTSNRSLALSLSISFNGLSAAFYALFANAISPFTPTIYLLLNAVLPLXVSVL

SEQ ID NO: 89477 - DNA, 813 bp, Zea mays
  misc_feature: Ceres CLONE 1577165
  misc_feature: Encodes the peptide sequence at SEQ ID NO. 89478
ggagctccccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcacgcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaagtcacccgcgcggcgatgctggtgcgcatcaacaccctcctccaggggctacctcggcatccgcttcgagatcctcgagggcatcacaaagctgctcaacaccggtgtcagccccctgcctgccgctccggggcacccatcaccgcgtcggggggaacctggtcccgctctcctaaattggcccggccttataaaggggccggccccaaat

SEQ ID NO: 89478 - protein, 211 aa, Zea mays
  misc_feature: Ceres CLONE 1577165
  misc_feature (41)..(211): Pfam Name: PAL Pfam Description: Phenylalanine and histidine ammonia-lyase
  misc_feature: SWISSPROT Homolog: EC 4.3.1.5 Phenylalanine ammonia-lyase
MAGNGAIVESDPLNWGAAAAELAGSHLDEVKRMVAHARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLLQGLPRHPLRDPRGHHKAAQHRCQPPACRSGAPITASGGTWSRSPKLARPYKGAGPK

SEQ ID NO: 89479 - DNA, 870 bp, Zea mays
  misc_feature: Ceres CLONE 1577166
  misc_feature: Encodes the peptide sequence at SEQ ID NO. 89480
  misc_feature (637)..(637): n is a, c, t, g, unknown, or other
ggagctccccgcggtggcggccgctctagaactagtggatcccccgggctgcaggaattcgtctcacccctagaaaaagttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccaagaactggaaatggacgatgataatgggcttgagcttactttgggcctatctttgggcgggtcatcagggaaggccaaggctagagatgcacctctagaaccaaaagcagaaccccaagtggaagaaagcagtagcaaaggtggtttacaaactcctgatgctccttctgggaaattttatcaaaagagcgctgataaccatgaacaaaatagtaaacagaggcacagccctgttgcaccacaatttgggaacttctggggacaaccagggnaattcctccggtccagtggtagatgggttctgtttgaaccggtggagtcatcagcctcagcctttccagttattaaaaatggggaaggatgcccatttaacagtgggaaaagatttctgaggaagcacgaggcccgttttctcgttaaaccaccaagtttccctttcctgaagaagaagaacctttttcgaaaagaaaaactcccgaaccgccctatgtggaccaagccctgt

SEQ ID NO: 89480 - protein, 165 aa, Zea mays
  misc_feature: Ceres CLONE 1577166
  misc_feature (88)..(88): Xaa is any aa, unknown, or other
MDDDNGLELTLGLSLGGSSGKAKARDAPLEPKAEPQVEESSSKGGLQTPDAPSGKFYQKSADNHEQNSKQRHSPVAPQFGNFWGQPGXFLRSSGRWVLFEPVESSASAFPVIKNGEGCPFNSGKRFLRKHEARFLVKPPSFPFLKKKNLFRKEKLPNRPMWTKPC

SEQ ID NO: 89481 - DNA, 984 bp, Zea mays
  misc_feature: Ceres CLONE 1577169
  misc_feature: Encodes the peptide sequence at SEQ ID NO. 89482
  misc_feature (67)..(67): n is a, c, t, g, unknown, or other
  misc_feature (68)..(68): n is a, c, t, g, unknown, or other
gtttgtgttaggtttttttttcgttctaacgaaacccgacccatgcccggcgcctacgagaaaaaannttttttttcaaactggagctcaccgcggtggcggccgctctagaactagtggatcccccgggctgcaggaattcgtctcacccctagaaaaattcgaggtttcttttgttccgtgtcgtgtcggaccccatcacgaccctcttctccgtttcgtatgccgaccaggcctcgccggctcaccgcccccgccgcgcccgccatggacttctcggaacaggacgtcgacgtcttcggcgaggactacgacgtccactacggcggcgccgatgccgaggccgaggccgacagcagcggggactcgtcgggctcctcctccccatcatcgtcctcgtcgtcctctgccgccgcgtcctcctcatcctcaagtggcggctcaagcctcatcagcagcggcggcgctgccagtgagggcgaggatcgcgccgatgcgggggacggggaggaatactattcgtccaacctcgtacccacaaggagcgccagcaccgccggctatctggacgatgagaggagggaatattaacaaccaggaggtagaggaggagagagatttgtttcagctcagataaacgaagagtaacgtcttgaactccgggcggcgcaagccacctaccctaagtccccattgccttccctcccaaattacgggaaaccactaaattaaatcagtgtcctcgaatggaaggctttttgggaaggtaccaagggttgggtaagaaggcccccacccactttttctttcaaaagggccaagggaaggcccatcccagggggcggactattaacctgtttggttttccgggggaaaaattccagggaaaatggggcggctctatggttttaaaagggtctttacatttttcaggaatattgtgaaagccctttcattacagaagcgcctagggaagaacccgtt

SEQ ID NO: 89482 - protein, 107 aa, Zea mays
  misc_feature: Ceres CLONE 1577169
MDFSEQDVDVFGEDYDVHYGGADAEAEADSSGDSSGSSSPSSSSSSSAAASSSSSSGGSSLISSGGAASEGEDRADAGDGEEYYSSNLVPTRSASTAGYLDDERREY

SEQ ID NO: 89483 - DNA, 755 bp, Zea mays
  misc_feature: Ceres CLONE 1577170
  misc_feature: Translation starting site: 179
ccccgcggtggcggccgctctagaactagtggatcccccgggctgcaggaattcgtctcacccctagaaaaaaaaatataggacctcaaaaggagttgaggtgtcgagcccctttgcattcatctctgtggaggatacgagtaagctggcaagtgaaccaaaagcgctgtgtgggcagatgagagtttatgacctgacaaaggggcgccaagtgggtggcctcctggccgagacacgtaaaccagaaaagatcgttgcaagtagttctggagaattcttgggcattacaaataaaagaaagctccatatatggcgcataccaacaaaagatttcaagcctgacaagataaggaagataaagctccggcacaccaaacacttgaccactctggcattccatccaactgagagaactgtggctggtggtgatgtaacagggcggatcctgatttggagatgttttggaaactcaaagttctctgaaagtagtgtacagtcgaaagaggatgacggaaggatgggttagggggggattgaatgatgcagacacttgcacaacatggcattggcactcaagcagtgtgaggtttctcaaagtttcttctgatggagcatacttgttttcaggtggttggaaggagttatttgggtggtgtggccactagatactggaaaagagaagtataaaacacgtctgggggtctcctccttttgtccttggaagaattctccagaattcttccttttccttgcgg

SEQ ID NO: 89484 - DNA, 872 bp, Zea mays
  misc_feature: Ceres CLONE 1577173
  misc_feature: Encodes the peptide sequence at SEQ ID NO. 89485
  misc_feature (872)..(872): n is a, c, t, g, unknown, or other
ctggagctccccgcggtggcggccgctctagaactagtggatcccccgggctgcaggaattcgtctcacccctagaaaaatccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcacgggcggggcgggctacatcggtagccacgccgtgctgcagctcctcctcgcgggcttccgcgccgtcgtcatcgacaacctcaacaactcctccgagctggccgtccgccgcgtcgccgcgctcgcgggggaccactccccgcacctctctttccacaagattgatctccgtgacaagggagcactggaaaatggtttttgcttctacaagatttgaagctgtcattcactttccctggaattgaaggctggggggtgaaaacgtaccagaagcctttaccttttttatgaaaaccaacggccattggcacgataaaaccttctaagaaagttatgtctgttccccggtttgcaaaaaaatttgggggtccccctccacccacctgcaggtttattgggtcccccccaaaaaactccccccccgggccagaaaaaaatttttcccccctttactcccaaaaaaatatcccctttgggggaaaaaaacaaaagcctccctgtgtttgtaaaaaan

SEQ ID NO: 89485 - protein, 90 aa, Zea mays
  misc_feature: Ceres CLONE 1577173
  misc_feature: SWISSPROT Homolog: EC 5.1.3.2 UDP-glucose 4-epimerase
MAVEKTLPGASAGRTVLVTGGAGYIGSHAVLQLLLAGFRAVVIDNLNNSSELAVRRVAALAGDHSPHLSFHKIDLRDKGALENGFCFYKI

SEQ ID NO: 89486 - DNA, 821 bp, Zea mays
  misc_feature: Ceres CLONE 1577174
  misc_feature: Encodes the peptide sequence at SEQ ID NO. 89487
ctccccgcggtggcggccgctctagaactagtggatcccccgggctgcaggaattcgtctcacccctagaaaaactcccactgctcgccctctctctcttacgcgcgcgtgacaacctccctccctccactgcgcgcggcgcgggagcagcagcggcagcacccaccgactgatcgccagtgggcggggcgggggcgatctgatgcgggcgcggcggtgatggcagcgccatccggcggtgggggcggcggtgcgggggagggctcctcctcggccgccgcagctgcgacgatcggggtccacggggtggaccaagttgcacaggcgatgtggcagatgaatttggaagaagccatggaactggggccatacccagagcgtgttggtgagccagactgtagctattacatgaggactggcatgtgcaggtttgggatgacctgtaaatttaatcacccagcagaccgaaagctggctgctgctgctgcaagaatgatgggagaatatccgtcaagtattgggcagcctgaatgtcaatactatcatgagactggcacgtgcaaagttggtagcaacttgcaaagttcatcatccccgagaaaaagcctgcatggcaacctccagtttcagtggaatgaactggggctaccccactccgcccgaaatgaaaaagagtggggctttattattgtaaaaacaagggcaagtgcaagttttggaaaacccaaggaaaagtttccccaattccacaaccggtccacccatggtgggttgcctgtaccctgggcaccttgtttttttccaccttggaaaagtcggcc

SEQ ID NO: 89487 - protein, 200 aa, Zea mays
  misc_feature: Ceres CLONE 1577174
  misc_feature (55)..(81): Pfam Name: zf-CCCH Pfam Description: Zinc finger C-x8-C-x5-C-x3-H type (and similar)
MAAPSGGGGGGAGEGSSSAAAAATIGVHGVDQVAQAMWQMNLEEAMELGPYPERVGEPDCSYYMRTGMCRFGMTCKFNHPADRKLAAAAARMMGEYPSSIGQPECQYYHETGTCKVGSNLQSSSSPRKSLHGNLQFQWNELGLPHSARNEKEWGFIIVKTRASASFGKPKEKFPQFHNRSTHGGLPVPWAPCFFPPWKSR

SEQ ID NO: 89488 - DNA, 712 bp, Zea mays
  misc_feature: Ceres CLONE 1577178
  misc_feature: Encodes the peptide sequence at SEQ ID NO. 89489
  misc_feature (192)..(192): n is a, c, t, g, unknown, or other
  misc_feature (193)..(193): n is a, c, t, g, unknown, or other
  misc_feature (208)..(208): n is a, c, t, g, unknown, or other
  misc_feature (379)..(379): n is a, c, t, g, unknown, or other
  misc_feature (384)..(384): n is a, c, t, g, unknown, or other
  misc_feature (385)..(385): n is a, c, t, g, unknown, or other
tggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgaatgaaagggagggacgnncaagcaattagcccntggatgggtgcacctttgctggggccaggggctctgccttgctttcttggggggaaagtttcttgttttccccaagggggggggttttaataaaatttttgggaaaaaaagtggggggtggggaaaacccttccccatatttttggggggggggggatttttttcaaaaantttgnnggggggaggaaaaattttttttttaaaccccccttttttttgggggcccccccccacaaaaaaaaaaaaagaagaccccccccccctttttttttgtttgggggggggggggggggggaaaaaaaacaagggggggggggggagaaaaaaaagggggtggccccccccgccggggggggggggaaaaaaaaaaaaaaaaaccccccccccccccccccccccccaattttttttttttaaaaaaaaacacacccctccctaaaaaaaaaaaaaaagagagagggggggggccccccccccccccccaaaaaaaaaaaaaaaaggagg

SEQ ID NO: 89489 - protein, 40 aa, Zea mays
  misc_feature: Ceres CLONE 1577178
  misc_feature (6)..(6): Xaa is any aa, unknown, or other
MKGRDXQAISPWMGAPLLGPGALPCFLGGKVSCFPQGGGF

SEQ ID NO: 89490 - DNA, 941 bp, Zea mays
  misc_feature: Ceres CLONE 1577181
  misc_feature: Encodes the peptide sequence at SEQ ID NO. 89491
  misc_feature (833)..(833): n is a, c, t, g, unknown, or other
  misc_feature (842)..(842): n is a, c, t, g, unknown, or other
  misc_feature (870)..(870): n is a, c, t, g, unknown, or other
ctccccgcggtggcggccgctctagaactagtggatcccccgggctgcaggaattcgtctcacccctagaaaaattcagccgcacgcttcttgttgcccaagagttccctcccctagccgccgccgccgctcgtctccctgagaggtgccgggaccgaggaactggccgagttctaggtagagaatcggttttgcttgtctcaacgcggggcctgctgcggctggcggtggcgaaggggagaaatccgcgagatctgtatcccgatctcgccgtgccatctcgggaatcatgggtttcccactgacctacttccatttgaatgtgatgctctagtggaggctcctggtggcccactgcctagcaatactcgttccgtgatgtatgaagctccccttggctacagcattgaggacgttcgacctgccggaggcgtgaagaagttcacagtctgctgcttactccaactggacgaagaagccatcctgatatccctgttggcttcctcattctagcacttcaggatttcctttctgacactttgattctggaccaatgctctctggcctgctgcttcctgatatatcgaccagttccccagtcttgctccgtgcactcctccctcctccatctccagcattgtgttctgatgtcacctgctaccatgagctgctctttctgctgctgatgcttccgcggtctcagctattgggttacgaggctatcatgaagcgcttgagatcacattctctgacgcacctgtctttgtggaccatgtgggcgtcgtttgctcgccctctccttggccgagatgactcagttctggatcatgccngctgcacantcgtgtcgagctctcgacgatgatttcnactacatgttcactctgagccagcttggtctctatgctctgaacatgtcatcagactgtggcatacgagct

SEQ ID NO: 89491 - protein, 44 aa, Zea mays
  misc_feature: Ceres CLONE 1577181
MYEAPLGYSIEDVRPAGGVKKFTVCCLLQLDEEAILISLLASSF

SEQ ID NO: 89492 - DNA, 860 bp, Zea mays
  misc_feature: Ceres CLONE 1577182
  misc_feature: Translation starting site: 223
  misc_feature (860)..(860): n is a, c, t, g, unknown, or other
ccccgcggtggcggccgctctagaactagtggatcccccgggctgcaggaattcgtctcacccctagaaaaagcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgtcgcagtcgccggggaggccctccgcggctgggcgccgcgccgcgccgacacgttcgagaaacttaataagataggatcggggcacgtacagcaacgtgtaccgggcgagggacaccgtctctggccggatcgtcgctcttaaaaagggccgcttcaataacctcgaggccaaaaagcgtccaagtttttgggcccgggaaaatactgtatccctaaggagactccgaccaccccccaacgttcatctaatttttagggggcttgggtccccctccccggaaatgttcttggcaggcccttttaacctttgttccttccaaggtaccattgggagccaaggaatacctttgccctgggatccttgggacgggaaaagattgttttgtttttttcccn

SEQ ID NO: 89493 - DNA, 1155 bp, Zea mays
  misc_feature: Ceres CLONE 1577184
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (878)..(878): n is a, c, t, g, unknown, or other
nggtggttggnncnnntcnttactaacccgctgcaccccgggctcgtttcgtcccctnnnnnncnntnnnnngcaaactggagctccccgcggtggcggccgctctagaatagtggatcccccgggctgcaggaattcgtctcacccctagaaaaaaccccccgcttttgctcctttcggtggcgcctcgcgcgagatccgctccgtgtgccccgccgacacgctgctgcctagatagagggtgtcctccccggcatctggttccaaggagagttgttgatttgggtacctgatacacttgggggtagattatctcggttgacgatttcaacctctgtcccattcctgctgctttgggcacttaagaggcttgcctgggtcacagatgatgtcattgagagtggagatggattctgcaagaagtcggttccagaagttccagcctagggataaatcgaagagtccaagctgtggggcccccccccctctaaaggaagccaggaacaacccccctacctgatgattgccacctgtcttagcggcgaacgaaatccagaatgcgtccgccccccctccaaaaccagtagcctttggacgaaattcagttacccgggagccccaagattgaaagttccccgggaccagggaaccctggaaaatgaaggaaggcccgcctgggaaatgttttgggaaagaagggaaaaaatttgaccccacggatggcgccggaaaatatctccccttggttcagaaaagagaaagccgtaacaacattacattagatttgcgctttagaatgccagtttgttggggggagcgaaaacaaacaacataccaccgcggagaattgttatttgccccccctttgtccacataantctcacccctggaaaatgcggggaacgtttgcgaaaacaattttattgggaaaccctttcttgaacacgtatttaattgtaggggtacaggacggtgttaattttttgtggagaagggaggcgaagtcctttgttgttcttgaggggaagagacgactctctcaaaataaaatgttttttatcccgcatgggacaaaataatcttcccaagagaaaaaccctcactaccgcccttctcgctattgggatgccccacgtcgtaaaaatattggcccaa

SEQ ID NO: 89494 - DNA, 771 bp, Zea mays
  misc_feature: Ceres CLONE 1577189
  misc_feature: Translation starting site: 154
  misc_feature (632)..(632): n is a, c, t, g, unknown, or other
ctccccgcggtggcggccgctctagaactagtggatcccccgggctgcaggaattcgtctcaccccctagaaaaaaccactcccatctccatccaaaaccataaaaaaaaccagtgcgagctgaagcatccaggctctggaatcatcgtcgggatgtctgtgccagcatcagcccaggtgcctcacaccatacgatctgctgggagctgctgcttcaggtcgtcgcatcaactatctgcgcagaatctgggccgacatcgcaggtggcgggggaccggaaagaagaagatcctttccacccgtggcgtgcttgagtccaggaacggtgcgcatcctggtggccttacgaagagaaggtgagaacctggagctgtagctacatgcggagctgtagctacatgcggagctgtagctagacagctagctgatctagtagcagcacacgccttgcaggaaggtcgtggagcacatcatcctgctcagagccaagcccaacatctcagacgctgaagagaaagacatgctggactacctatacacatcgcagtaccagatgcgagggatactcgcggtctcgctaggccgcatcgaggaccccaacagcgacaacttcacgcacgctgtgttcatgncgtttccagcagaagcaagaccatcgcggagttccagagtaacgcggtactactcccaaagttgtccaacgagccacttaaaagccccgtttcctattgaacccccccagcccccccagaatggggaaaaaactcttct

SEQ ID NO: 89495 - DNA, 765 bp, Zea mays
  misc_feature: Ceres CLONE 1577192
  misc_feature: Encodes the peptide sequence at SEQ ID NO. 89496
ctccccgcggtggcggccgctctagaactagtggatcccccgggctgcaggaattcgtctcacccctagaaaaatagcatgttggacacaaccatatcagcatcctctaaacaggagagtggtgaggggagccgtctttttaaagtcatggcaaaatcattttctaaaagatggcaaagtggagaaattacgaacttccaatatctcatgcatctaaatacacttgctggttgagggtatagtgatctcacacagtacccagtatttccatgggttctcgcagattatgagagcgatgttttagatctgaggaatccacagacatttcgcaggcttgataaacccatgggatgccaaacggaggaaggtgaagaggaattctgcaagagatatgatagctgggatgaccctgatgtaccaaagttccattatggctctcattattcaagtgctggaattgtccttttctatctcttaaggttgcctccttttagcacagaaaatcagatattgcagggtggacaatttgaccatgcagaccggttattcaacagtgtgaaggatacatgggtaagtgctgcaggcaaaagtaacacatcagatgtgaaagaactaattcctgagttctattatttgcctgaatttttggagaaccgttttaatctggatctgggcgagaaacaatcaggagaaaaaggtgggggatggttgtttttacaacccttggactaaagagcagcgccagtagagttcatccgggaaaca

SEQ ID NO: 89496 - protein, 51 aa, Zea mays
  misc_feature: Ceres CLONE 1577192
MLDTTISASSKQESGEGSRLFKVMAKSFSKRWQSGEITNFQYLMHLNTLAG

SEQ ID NO: 89497 - DNA, 958 bp, Zea mays
  misc_feature: Ceres CLONE 1577196
  misc_feature: SWISSPROT Homolog: EC 4.1.1.50 Adenosylmethionine decarboxylase
aagctggagctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgatgcacctgtccttgtggaccctcatgggccgtggtttgcgtgccctctccaggggccagattgactctgttctggatcttgcacgttgccaattgttgtcgacctctcaacaggatttcgactcatatgtccctccggatcagcttgtttatctatctctgaaattgtcatcaggactgtggactacaagctcctgctacattcaaga

SEQ ID NO: 89498 - DNA, 923 bp, Zea mays
  misc_feature: Ceres CLONE 1577197
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (177)..(177): n is a, c, t, g, unknown, or other
  misc_feature (178)..(178): n is a, c, t, g, unknown, or other
  misc_feature (515)..(515): n is a, c, t, g, unknown, or other
ttgtgggtgggtgtgtctcccctcacctccgcacggcaggtaagtccctgggggggnnnnntttttttcaaatggactcccgcgtggcgcgctctagactgtggatcccgggctgcaggattcgtctcacccctagaaaagctccaggacgtacgtacgtacgtagaatcgatccanntcgatcgctagctagctgacgaccatggcgtccctctcctctgccgccatcaccgccccttccttcacggccgcgcccgctcgcgcagtggtcgcaggaggtccttcaccgtgcgtggctctctccgcagggcactggcaaccgccgcgtgggccgttgccgccagcgtcctgcttggcggggggcggggccctggccccagaaggtgctttgctggggccagggaaaagggggggtttttttttctaacccccaacccggtttccccgtgaagggggggggggaaaaccctttccccccttaaaaaaaaaaaaaggcccccgggttttttcccccnaacaaaaaacattttggtttttccccaaacaaaaaaaacaaaaaagggtgccccaaagaaggggggggggttaaaaaacaccccctctccaaaaaagaaattctcctccccccggggggagggggaggaaaatttttctcttaaaaacgtgcggccccccggggggggagaaaaacaaatatttttttgtggtggggaacccccctcccccccacccggtggggggggggggaaccaacaaaagggggggttttttttttttggtggggggggcccccccccccccccccaaaaaaaacaaagagaagttggtttcgcgtaaaaaaaaaccaccacccctatcaaaaaaggaaggggggggtgtccttcttcttctcccgcggggggttcttttggcggggaggggcg

SEQ ID NO: 89499 - DNA, 1145 bp, Zea mays
  misc_feature: Ceres CLONE 1577198
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (73)..(73): n is a, c, t, g, unknown, or other
  misc_feature (77)..(77): n is a, c, t, g, unknown, or other
  misc_feature (78)..(78): n is a, c, t, g, unknown, or other
tgtgtttttttnnngnnnntggagggnagagggaaacggagggaggagggggaacacgtaagtttataagttntttnncaaaactggaactccaccgcggtggcggccgctctagaactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatggtgattcagttgtaagctggtgaaatttgggcaagactccaatttcctctcatctggagttcaaaaaaacgtttggcttgggtcctccctgctttccccttggaagtccttgacaaacccataaagattttcccccccactccaccttttcggggggaccttggaaccaaacaaatctcccttttttgggggcccctggttcaaaggcctcgcgcaaaataaacttcccccttttcccaaaaaaaaaaaccttgggttccttaaaaacagggttttggggaaaatttggagccacctgtgggttttctcacctcggacgatgtggtggagagcacactattgcacaaaaacattttttggcgtcttaaaaaaaaacgtctctctttgtaaccccagtggcagcggtgccaagaatattctcggggtggggcatgtgaacacgcactcttgttttataaaaaaaagaaagtagggctcatccaccttatacccgtgcgggacccaaggcgtggtctgggtgagagaaaaattttattggaggacaaggtctctaaagagtctctcctatcccttgtgtcccccgggtagcgacacctctcgaaagccgtatgcgctggtccgtgccaggaggggggaaaacaagagatgggaatccaaccacctaaaaaaaaaaattttttaggcggctttttatacccagagaaaaagaattt

SEQ ID NO: 89500 - DNA, 870 bp, Zea mays
  misc_feature: Ceres CLONE 1577199
  misc_feature: Encodes the peptide sequence at SEQ ID NO. 89501
  misc_feature (696)..(696): n is a, c, t, g, unknown, or other
  misc_feature (777)..(777): n is a, c, t, g, unknown, or other
  misc_feature (792)..(792): n is a, c, t, g, unknown, or other
tggagctccccgcggtggcggccgctctgaatagtggatcccccgggctgcaggaattcgtctcacccctagaaaaaacttacctggacggggtcgacgggggatcaagaagcctcgtggcctaggccagtggcccgcattgcacatggtgggtgcgctggcttaccatctccccaagtgggagagtggacgtcataatttgtaatttgtggtagagggggtacgcgttcgcgcggcccctgccaaatcttataaatttatttaagtccctttagagaagggcttgaaatgtaatctttgttttatccccttcagtgaaggcttgaaatggtacttttgttcccccgattttataaattaaaatttaatttaactggcctccaaaaaatgtttacaaaattacccccggaccgcctgaaaaaaattctttttggggaaaaaaaattaaaatatattttttcccaaaaaaaaaaaaagccctgggtttccaattttcgaccccccctccggtttccccatttccccgcccccttaaaatatcaatccccctccgttttttttgggggggctttttttccccctttgggggggcacaaaaaggggggggtataaaccctgttttttcctctcgccccccccgcccccccgaggttcgcgccaaaataaatttgtgggggcccccaaaaaacctcattntcggccatttggtggagggggtgggtgtctttttgtgaccaccccctcccctggcggggtgttttttttttataaacaccnccaacaaaacacatnttgtggggcttcttcgcgtgggagctcctccttttccaccctctttcttatgggagagaaaacaccgcacttcccccc

SEQ ID NO: 89501 - protein, 40 aa, Zea mays
  misc_feature: Ceres CLONE 1577199
ELPAVAAALNSGSPGLQEFVSPLEKTYLDGVDGGSRSLVA

SEQ ID NO: 89502 - DNA, 850 bp, Zea mays
  misc_feature: Ceres CLONE 1577201
  misc_feature: Encodes the peptide sequence at SEQ ID NO. 89503
tggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctacgcacctacgaacacgtcgttctctcccgcacgcgctccctggtgtccgacatcatcatgtacggcgccacggactcgtgcttcgcgcccaacggcgaacacttccgcaaggcgcggaagctggtcactgtgcacctgctcacgccagcaaagtgctgtcgcacggcccgccggaaaaaaaaaaaaggcccccgccccctctcaaaggg

SEQ ID NO: 89503 - protein, 195 aa, Zea mays
  misc_feature: Ceres CLONE 1577201
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASATKNDGAAPASDPDKLLSLLPSPPMKLPIIGHLHLMGDIPYVSLAALATRYGPDLMLLRLGAVPTVVVSSPRVAEAVLRTYEHVVLSRTRSLVSDIIMYGATDSCFAPNGEHFRKARKLVTVHLLTPAKCCRTARRKKKKGPRPLSK

SEQ ID NO: 89504 - DNA, 792 bp, Zea mays
  misc_feature: Ceres CLONE 1577202
  misc_feature: Encodes the peptide sequence at SEQ ID NO. 89505
ctccccgcggtggcggccgctctagaactagtggatcccccgggctgcaggaattcgtctcacccctagaaaaatatggattcgggaaaagctccaaccctaggggggatcggacaacgcctccatccctagccgcctcctgcaagtttcagagctcaagagtcggggcgccatggcgacagagacggatactttcgcctttgcaggatgagatcaaccagctgctctcactcatcatcaataccatctattccgactaggagatcttcctccgggagctgattgcgtactcttccgatgggttggacaaaatcgggtgcaagagcctcactgacaagagcaagctcgatgcgcaaccggagctgtacatccacattgtaccagacaaggcttcgaacacgctcaccatcatcaacagcgacatcggcatgagcaagtccgaccttgtcaaccacctcggtaccatcgacaggtcacgaggaccaaggagttcatggaaacccttgctgctggcgctgatgtgtctatgagtgggcagttcggtggcagtttctactctgacctgcctcgtcgccgagagggtcgtcgtgaccagcccagcatgacaatgaccagatgtacgtgtgggaatcccacgagagcagggtccttcactgtgactgcgaacaggtactggcgagcagcttgacacgagtactaagattacactttactctcgcgaagatccgttgtaatacctagaggagcgtctcctctagcattatgacaacaagcagtctgcagttcatcagt

SEQ ID NO: 89505 - protein, 33 aa, Zea mays
  misc_feature: Ceres CLONE 1577202
MSKSDLVNHLGTIDRSRGPRSSWKPLLLALMCL

SEQ ID NO: 89506 - DNA, 1054 bp, Zea mays
  misc_feature: Ceres CLONE 1577203
  misc_feature (15)..(15): n is a, c, t, g, unknown, or other
  misc_feature (19)..(19): n is a, c, t, g, unknown, or other
  misc_feature (686)..(686): n is a, c, t, g, unknown, or other
  misc_feature (860)..(860): n is a, c, t, g, unknown, or other
  misc_feature (983)..(983): n is a, c, t, g, unknown, or other
  misc_feature (1020)..(1020): n is a, c, t, g, unknown, or other
  misc_feature (1054)..(1054): n is a, c, t, g, unknown, or other
ttttttttttgtttntttnttggtgttgctggttgggaggtgggggggggtggtggggggagcctggggggaaggagggaaaaagtgggactcccctcggtggcggccgctctagaactagtggatcccccgggctgcaggaattcgtctcacccctagaaaaaacacccacacccaccaacacaaccgcacctcgcacccattgaccagacggcggagctcatctcctcccccacggatatccccatcagcctgctggcttctccccggcgtccccgatactgatcctcatcactcatgtctgccgaagttcctggacggacacccttatttcctctctggcgacttctggtctcatatactggcagaaactccgagatgttacttgattacgggtgagaacactcccagttgagagcaaatacttccgaccgggtcaatcaaatggaacccgagaaatttggccggactcaatttactatcatctggaatgcagaaaacgattggcttgcagttcttggcttcgcctggggtccatggcaaacagttaggattactctcaccccccttttcagtggaacattgaccaaacggtctaatttttgggaggcaagcttcaaacccttcgaacaaccgattcccccttcccaaaaagagcctccggttcttaaaaggaacccgccgangttgaaaaaattaggggtccatttttatactgaaaaaagggcccccccatgttttctttgcagggaaaaacaaaactttgtggacattgtactccgcaacgtctcctaggtggggaggcaaacaacctgttgtggggaaaaaaaccagggggccttttggttcccggaggagantgtgccctgcgggaagggaattgggggacgcccaaaggggttgggacgtttcccccgtggggccccagggagcccgggcctaaaaacgtatccctcctctagtgcgggggggaaaaaaaacgngcttaaaaaaagtgcttttagaaaacatgtccccggncctttttataccacggaaagaaaccgcctgggan

SEQ ID NO: 89507 - DNA, 962 bp, Zea mays
  misc_feature: Ceres CLONE 1577204
  misc_feature: Encodes the peptide sequence at SEQ ID NO. 89508
  misc_feature (949)..(949): n is a, c, t, g, unknown, or other
ctggagctccccgcggtggcggccgctctagaactagtggatcccccgggctgcaggaattcgtctcacccctagaaaaacccgactccctcggctgcctcccgcagccgcccgctgctccggtccttccgaacgctggcctgttcttccctgcctttggcccattcgtcaggcggcccctccgcaggcgacgcaggcgcggtcacgactgcgcgtggccccgactacgtagacagctaaccggtctccgcctccggcccttctcctgtcgcccgattgagtcgctgctgcaactgccaacttcacccccggcgagctcaccacagtcttccggataggtgctatcaatttggaagatggcagatgaggagcaggccccaagctctaggaaaagggttgcacgtactcaaatcaacaaggataatccggaacctgatgatgaaggaacagaacaagagatgggtacatttaagaaagctactgaagaagttatggcaacacggaggattgtaaaggttcggcgccagcagacgtcatcagcttcttctaaccctttctctgcaatcagatttgcccccactgattctagtgctcaaacaagtgctcctgtaccagaggtccaaccttcagatgtcaaagttgacgaggggagcaatggtagcgggaaagatactttgtctctgcccgacaagactgctggctctggagaaataccgactctagtgcctcaaccgaagcaccacctcaccctgttgaaaccagtgacaaggcagaagacccaatggacgaattctgtggagacaaagtgtttgtttggaaacccaatgaaagcagttgcatgcccatctgaatttgagggaaaacaaaagagggagatgctgcagaaatgaaaggacacatgaggctggaatttcgttaaattggccacgtgacctggggaagaagaagnaatgacctcggaa

SEQ ID NO: 89508 - protein, 177 aa, Zea mays
  misc_feature: Ceres CLONE 1577204
  misc_feature (10)..(166): Pfam Name: NUP50 Pfam Description: NUP50 (Nucleoporin 50 kDa)
MADEEQAPSSRKRVARTQINKDNPEPDDEGTEQEMGTFKKATEEVMATRRIVKVRRQQTSSASSNPFSAIRFAPTDSSAQTSAPVPEVQPSDVKVDEGSNGSGKDTLSLPDKTAGSGEIPTLVPQPKHHLTLLKPVTRQKTQWTNSVETKCLFGNPMKAVACPSEFEGKQKREMLQK

SEQ ID NO: 89509 - DNA, 807 bp, Zea mays
  misc_feature: Ceres CLONE 1577208
ctcaccgcggtggcggccgctctagaacagagtatcgcccgggctgcacgaattcgtcgcacccctataatatagtgttggctcctcgaccctcctgcctctccggcactcgctcctgtcccaacatctcctcgtcaaccccctccttgtgatagggttagagttcccccggcaccagcgcgagccatgatctccttcacactgctcacaagtccgcgctgcagatgcaggcggagcctctccacttcctcaggtaccagcggcggagacggccctgggggcgccattccggctagctccctcttcttgggccggccgctggcggcagtgcatgatgcccgctgcctctctgcgtggtccgctggggctacgcgctgcgggtcacgtgctagaatgtggtgcggatcgacctgtgcacaccatctgagctgtcgccaccaatgatggcgggcagctgaccgtcgtcaccactgcgtcggtgcgcgcactactccctcgatagtggcgtacaccaagaagaggatcgtctggaggagctatcgatcacgcatgcagtcgcgaacccgaaaacactgtttctatggcgagcacatgatccgccgcaagaagcctgaggtccaccaccagggctaggctggtcccgtacggggttgtcgaagaccataaccggctaccccaaaaccaacgtgccccggctatggggcatcagtttgctggccgagggaaaactttgcccaaggttttttaaggaaggtgggggaattgagccaactgaaattgtcttaacggaaaaaaattcccaaaaag

SEQ ID NO: 89510 - DNA, 791 bp, Zea mays
  misc_feature: Ceres CLONE 1577209
  misc_feature (280)..(280): n is a, c, t, g, unknown, or other
  misc_feature (713)..(713): n is a, c, t, g, unknown, or other
  misc_feature (746)..(746): n is a, c, t, g, unknown, or other
ctccccgcggtggcggccgctctagaactagtggatcccccgggctgcaggaattcgtctcacccctagaaaaagccggccggaccacccagagccagaagcgcgtcgccagccaactatcgccgctgataaccaacccaatccaacctaacccaaccctgctctctgccgacgcggattcgaatccgaggacgatcgatgacggtgggcgccggcatcgccgtccaggacggcagcctcctggcgctgggcgccaaggtcctgcgggaggtgcgcggcnaacgtgctcgtgacgccgggccgccgggcgggggcctaaaccaaacgggccgcgtttccctcggggcgtcccgggtccgggggccccggcgggcccaggcccggaaaaaaatttttttccccccgtttggggggaaaaaacccccctggggggaaaacaccccgcgggggtgtttttttttgtgttgtgtgttggggacgacaacccctcactaccccccccccctcctaataaaaaaagaaggggggggggggggccccccccccccagggggggggggggggtttcctttcgaggggggggaaaaaaaattcaccctcccctcttagaaaaaaaaaagaaattttttttttctttggtggccgaggggaagaaaaaaaaaaagatgccccacctggggggcggtggggaaaaagaaaaaaaaaaaaaccanccccgcgttaggtatataaataaaaaaaaaaantaaattccttttttcctcttaccccccccgcgcccgggggggggg

SEQ ID NO: 89511 - DNA, 910 bp, Zea mays
  misc_feature: Ceres CLONE 1577210
  misc_feature: Encodes the peptide sequence at SEQ ID NO. 89512
  misc_feature (706)..(706): n is a, c, t, g, unknown, or other
ggagctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggacatccgccctgcaggcggcatcaagaagttctccgctgcttactcgaactgcgcgaggaagccatcctgatatctctgtcgtcatcccccatctagtagcgtagaaaacacctgcattttcattttgatctcccctaatccctccgggtagctgcttttccagttgacaaaaagatatcaaagaacacttcccgtcttccttcccggggcctgtctgtcattcgggctcttaaaacgatgggaaatcctcgaagtttgttggctgttgccccctcccccgggctctcggaattgggttttgaggggattngagaaagcgcccttggaaatccctttttcttaaagggccccttggttttggctggacccccccggaaaagggggaaaaggggggggctttctgccgggccccaaaaaaacacttgtttttttaacccttttcgggggcgcccctgttgttccccaagctttcctaaaaggaggaatatcaacctttttgtgttttttttgggaa

SEQ ID NO: 89512 - protein, 51 aa, Zea mays; identical to SEQ ID NO: 13325
  misc_feature: Ceres CLONE 1577210
  misc_feature (1)..(51): Pfam Name: AdoMetDC_leader Pfam Description: S-adenosyl-l-methionine decarboxylase leader peptide

SEQ ID NO: 89513 - DNA, 823 bp, Zea mays
  misc_feature: Ceres CLONE 1577212
  misc_feature: Encodes the peptide sequence at SEQ ID NO. 89514
  misc_feature (551)..(551): n is a, c, t, g, unknown, or other
  misc_feature (556)..(556): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaagcctgtccctccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaagtacgtcgacctgggctgcgtcgtcgtcgacccgcagatcttcatgtggaccgtcggcaccatcctcggccctcggcgtctcatcggcttcatcatgatgatcgtcaagctcgtcccgaaaagnggccnngcgcgccgccggccgacaagtaccgcagggcctgcacaaggccctcttgttcttcacgggcaacgaatcggtcccctgccaaacccaagggggtaactgggaggggaattcccgctgaaaggagggcctcccaaaaaacccttcccccggaatgtggcggagggctttcaaatggggggggaccccccttagtttaacccccccggggggggggccaaaaaccctccccccggggggggggccacacaccgcggggaaatattttg

SEQ ID NO: 89514 - protein, 133 aa, Zea mays
  misc_feature: Ceres CLONE 1577212
  misc_feature: SWISSPROT Homolog: EC 3.2.1.4 Cellulase
  misc_feature (100)..(100): Xaa is any aa, unknown, or other
  misc_feature (102)..(102): Xaa is any aa, unknown, or other
MFGRDPWGGPLEISNADSATDDDRSRDLDRAALMRQLDETQQSWLLAGPGDQAGKKKKKYVDLGCVVVDPQIFMWTVGTILGPRRLIGFIMMIVKLVPKXGXARRRPTSTAGPAQGPLVLHGQRIGPLPNPRG

SEQ ID NO: 89515 - DNA, 854 bp, Zea mays
  misc_feature: Ceres CLONE 1577213
  misc_feature: Translation starting site: 255
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (720)..(720): n is a, c, t, g, unknown, or other
  misc_feature (728)..(728): n is a, c, t, g, unknown, or other
  misc_feature (729)..(729): n is a, c, t, g, unknown, or other
ctggagctccccgcggtggcggccgctctagaactagtggatcccccgggctgcaggaattcgtctcacccctagaaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagcctcgccatcccgcagggcatcagctacgccaagctcgccaacctgccgcccgtgctcggactctactcgagcttcgtgccgccgctggtgtacgcgctgatggggactcagacgcgtggggannnnnnnnnnnnnnnnnnnnnnnnnnnnnnnnnnnnnnnnnnnnnngnnnggnngnggggggnnnnngaagggggaaccngggggtcnncctggggcccggccttccccgcccccttttttcgggggggtcttcccgggctcgctcgggcctcttcgggttgggggcttcttccgggggcctgcctgtcgcccgccccgtttgtgggggttcct

SEQ ID NO: 89516 - DNA, 812 bp, Zea mays
  misc_feature: Ceres CLONE 1577214
  misc_feature: Encodes the peptide sequence at SEQ ID NO. 89517
ggagctccccgcggtggcggccgctctagaactagtggatcccccgggctgcaggaattcgtctcacccctagaaaaagcctcgaccgcaacaaagactacaggggggagacacatctctccccacctcgcttcgcacctctccagccgccgcctcctccttcgccggcgtcgacgatgggtgactatggccacggcggggggcagatgcggggcaacccggactcccgccccaggggccagggccagcgccctaacgtccagcagctcaagctcatggggcagatccacccgacggggctcacgcccaacctgcttaagctcttcgaaccgcgtccaccgctcgagtacaagcccccgctggagaagcgcaaattgccggcctacaccgggatggcacaatttgtgtcgcactttgctgagcccgaggatccagagtatgctccgccagtacccaagtgtgagaccagggcagagaagaaggctagaattcgcaataataagctcgagcaaggcgcagctaaggttgctgaagagcttcagaagtatgacccacaaagtgaccccaatgctactggagatccatacaaaacactctttgttgctagacttaactatgagacatctgagcagaggatcaaatgcgagtttgaaggttatggtcctattaaaagggttcgtcttgtaactgagaaagatccaagtaaacctagaggatatgcattcattggagtatgtgcacaccacgagacatggaaaaatgcctaccaggcaagccgatgggggagaaaaagtggacaacagggaggggta

SEQ ID NO: 89517 - protein, 212 aa, Zea mays
  misc_feature: Ceres CLONE 1577214
MGDYGHGGGQMRGNPDSRPRGQGQRPNVQQLKLMGQIHPTGLTPNLLKLFEPRPPLEYKPPLEKRKLPAYTGMAQFVSHFAEPEDPEYAPPVPKCETRAEKKARIRNNKLEQGAAKVAEELQKYDPQSDPNATGDPYKTLFVARLNYETSEQRIKCEFEGYGPIKRVRLVTEKDPSKPRGYAFIGVCAHHETWKNAYQASRWGRKSGQQGGV

SEQ ID NO: 89518 - DNA, 823 bp, Zea mays
  misc_feature: Ceres CLONE 1577219
  misc_feature: SWISSPROT Homolog: EC 1.1.1.86 Ketol-acid reductoisomerase
  misc_feature (823)..(823): n is a, c, t, g, unknown, or other
ctccccgcggtggcggccgctctagaactagtggatcccccgggctgcaggaattcgtctcacccctagaaaaaagcggaccagcaagcgcctctctctctctctctcgctctctctcactggcggcggcgacttcctcttccacctacctcgccatcggccgcaaaaccctaaagcccgccccctccgtagccacagccgccacctccgtctccttccccgccacgcagcacccatgcctcgtcgccgcctccgcggaccggcgccgcgccgtggctgctaaggtctcgtcgccgacggtcatcggtaccgccatgccgtcgctcgacttccagacctccgtctgcaagaaggaaaaggtgtccctggccggacatgaggagtatattgtgaggagtggcgagggatctgttctcgctgccaccggatgcctgttacggaagcaaacatatcgcggaaatctgctggggctcgcagggccctgctgaagctcagaacctgagagactcggttgatgacgccaactcagatactgttgctaagatcgatctccgaagacgttctgaatgctgcagagcaacccgagcagcaagattcgccaaatagactgcgaggatggactatacatgggagactaggacgaacagggatctggtgttgcgagcgcaatctgattcttctcagcgtgataactacaagaaaaatgtgtcggcagaggaaatctaaatgggatggaaggactgtacccttggaatctggccctgaagccaaaagcataaccggaggttttgctctggcggaaaagttatcaagggaccttccn

SEQ ID NO: 89519 - DNA, 882 bp, Zea mays
  misc_feature: Ceres CLONE 1577220
tccccgcggtggcggccgctctagaactagtggatcccccgggctgcaggaattcgtctcacccctagaaaaaaatggagagttcgaccctggctcaggatgaacgctggcgcgcatgcttgactcctgctattccaagcgcaagtggtgtttgccgtggccagcgggtgagtgacgcttcaaagcctgcccttgggaggggaacaacacactgagacacggttgctcatcccccgtaggctgaggagatcaaggagaaatccgcccttggaggggctctcttctgattagctagtgggagaggcagtcgcttatctaagggatgatcgacatctgatgctagaggataatcttctacactggaacacacacaagtcccatactcctacgggaaccagcacatggggatacttttccgcgttgcgcatacacctgacggagctatacctcatcgaaggtgccaaggcctgcggagacatcatcttctctttcacagataagaacagtgacggtatctgaggaataatcatcgacttattctgtcctaacagccgccgtaacactcaggatgcaatctctatccgcactcattgggcttacaagcggtctgtaggtggtttttcaaggccctacgacaatatcccccggcttaaccttggacggggcgcgtggatacctcctatctggacttctgaaggggcaaagtgcatttcctgatcaatctgtgaatggcattggaatttggaatcaacaccatcgtcaaaggcaatcttgtttgggccaaccttgacacctgggatacggaacgttgggggaagccaatgggattaagagatccccagtttatccccaagcctctgagccaagggatacttacgtggc

SEQ ID NO: 89520 - DNA, 804 bp, Zea mays
  misc_feature: Ceres CLONE 1577222
ctggagctcaccgcggtggcggccgctctagaactagtggatcccccgggctgcaggaattcgtctcacccctagaaaaagagctcttacacccgtccagaaggcaggagagataagactgtagctaagctagccaccgcgcgcgcgcacgtagtactctagctagaagacagtcgcgctcaaaacaaacaccaacagcgtcatggtgcttgatccctgacgccctcgacgactaccgcaatcagctagccgctgatggcggccaccgtagcttcctgcctgaggctcctgcccgccgtgcaccacgcggggcggccgggtcctcagcactgtggtactgacgaacacgcttcagcgaatgactcattctggccgctatcttgtcgtcatctgggccaggagatgccaatcggaagccacccctgcgaccatctaggaccgggacgtaggtctcatgaagccgcgacctacgaccgtgagctcccccacggatagggggcaagtccaccgcaaaaaaccagtggggagggatggtgtggaaacccattccatggggtggatctttcggggaaccccgggcaggtaccgcggaaatccgccccggggggaacaaaggaaagggtttcaatttaaaaggggctttccccccccaaagggggggagggatttaaaggtcccccgggcaaaaaaccttttattccccccaaagttgggggtctctggtgggggccctttggggaccaaaagggggaaccccaggtttcccttcttgggccccccccttgtgtataaagagaacccccc

SEQ ID NO: 89521 - DNA, 891 bp, Zea mays
  misc_feature: Ceres CLONE 1577225
  misc_feature: Encodes the peptide sequence at SEQ ID NO. 89522
aaagctggagctccccgcggtggcggccgctctatgaactagtggatcccccgggctgctggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcagggcgcggccgacgacggggagctcgccgcgcggtggcgggaggtccacggcagcaacaactgggaaggtctgctggaccccatcgacggcgtgctcctccaggagctcatccgctacggcgagtgcgcccaggccacctacgacagcttggactacggacggcttctgcccctactggggcagctggcaagtacccggggaagaactttcttcacgaagtaagggctcgggcgggatcgggctacaaaggcagacctgataaccttctaacgccaacagggcaacgaacctcaaagtgtcgcacaaatttgcgggaattaaagaaagggccggccgaaacgggccaagaagtgttgtaaaaaaaatattcccaggggagcgtgtctaatccgaggggtgcacatgggggccgcggtggtatcgccaccg

SEQ ID NO: 89522 - protein, 141 aa, Zea mays
  misc_feature: Ceres CLONE 1577225
MAATVSSCLSLVPTVHHRAGGFPSSVALTNTLQRRRRSRRYLVVASATRAEQEAAPVTIEDVDLSSHQGAADDGELAARWREVHGSNNWEGLLDPIDGVLLQELIRYGECAQATYDSLDYGRLLPLLGQLASTRGRTFFTK

SEQ ID NO: 89523 - DNA, 954 bp, Zea mays
  misc_feature: Ceres CLONE 1577227
  misc_feature: Encodes the peptide sequence at SEQ ID NO. 89524
ctggagctcaccgcggtggcggccgctctagaactagtggatcccccgggctgcaggaattcgtctcacccctagaaaaaatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgacaacctgatcgggacgctgacggtgcgcgagacgatcggctactcggcgctgctgcggctgccggacagatgccgcgtgatgacagcgcgcgctggtggagggcacatcgtcgagatggggctgcaggactgcgccgacacgtcatcggcactggcaccctccgcgggtcagctgcgcgaagagcgcgcgtcacatcgcgctcgagctactatggcgccgcgcctctcttctcgagaagccaccagcggctcaaagctcgtctt

SEQ ID NO: 89524 - protein, 246 aa, Zea mays
  misc_feature: Ceres CLONE 1577227
  misc_feature (104)..(240): Pfam Name: ABC_tran Pfam Description: ABC transporter
  misc_feature: SWISSPROT Homolog: EC 3.6.3.28 Phosphonate-transporting ATPase
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNGRKAKLSFGAAAYVTQDDNLIGTLTVRETIGYSALLRLPDRCRVMTARAGGGHIVEMGLQDCADTSSALAPSAGQLREERASHRARATMAPRLSSREATSGSKLV

SEQ ID NO: 89525 - DNA, 888 bp, Zea mays
  misc_feature: Ceres CLONE 1577229
  misc_feature: Encodes the peptide sequence at SEQ ID NO. 89526
ctcaccgcggtggcggccgctctacaaatagtggataccccgggctgcaggaattcgtctcacccctagaaaaaatccgggaaagcagccctaatctcaagggcgcgggtgcgagcgctgcttaccacctcccaactcgggaactcctccccagtcgccgacagacgcgcgcacacccaccgagagctcgggctttcgttctccgttcctccctcgcgcgctcagggtttcacgatggaggacgagactgcggccaagagggcgcgggaggacggggaggacgccaccgcgccggaggcgggggccgaggctgtggtcgtcggtgctagcaagaaggtggggatctccgccgtaatcccaggagtggttctacgagatcagccccatgtggccctgagaggcgcactccatgaaggtggagaaggtgctgttccatggcaaggcagactaccaaaatgtgatggttttacagacctccgcgtacgggaaggtgcatgtcctcgacggagttattcaagtgacacagacggatgagtgtgcgtaccaatagatgattactcacctgccacattgctccatcgaaagaccgcaaaaaggtgttgggtattggaggggggggatggatcgagttttcggtgttctttgcaatgtcgcggatcaattggtgacagatatctgaaagccatgggataattccagtcccagagggaaccaatagttccgcggggctaagggatgacgagtggccttaattcttgccagccaacggcctcttggaaggtaatgtccaatggaagagggattttgaaatccgctcgcaagcgggatacttttggggcgggaaaaagaaaagtaccaggctccattatcggccccacggggtgtggt

SEQ ID NO: 89526 - protein, 46 aa, Zea mays
  misc_feature: Ceres CLONE 1577229
  misc_feature: SWISSPROT Homolog: EC 2.5.1.16 Spermidine synthase
MKVEKVLFHGKADYQNVMVLQTSAYGKVHVLDGVIQVTQTDECAYQ

SEQ ID NO: 89527 - DNA, 802 bp, Zea mays
  misc_feature: Ceres CLONE 1577230
  misc_feature: Encodes the peptide sequence at SEQ ID NO. 89528
  misc_feature (767)..(767): n is a, c, t, g, unknown, or other
ctccccgcggtggcggccgctctagaactagtggatcccccgggctgcaggaattcgtctcacccctagaaaaagaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggccccagggcaccaccaacgtcggccgctaccgcatggtgggagcccacccagtgatggagattgttgccaaagaccacaaggtacgatcatggaccacgagaagagcccagtggccgaacaagtagtggacgacccgatgcagatccccgagacatgatggagggatggcacccccagcagatcgacgagctccctgatccctctccgtggaagggggttgggttcctttcctctgaaacgggtaaggttgtttaggaaaaaaaaactaccgtttctcccgtgctccctcagacnattaggaccttccctgatggggactggggatctct

SEQ ID NO: 89528 - protein, 169 aa, Zea mays
  misc_feature: Ceres CLONE 1577230
  misc_feature: SWISSPROT Homolog: EC 4.1.3.27 Anthranilate synthase
MESLAATSVFAPSRVAVPAARALVRAGTVVPTRRTSSRSGTSGVKCSAAVTPQASPVISRSAAAAKAAEEDKRRFFEAAARGSGKGNLVPMWECIVSDHLTPVLAYRCLVPEDNVDAPSFLFESVEQGPQGTTNVGRYRMVGAHPVMEIVAKDHKVRSWTTRRAQWPNK

SEQ ID NO: 89529 - DNA, 1173 bp, Zea mays
  misc_feature: Ceres CLONE 1577231
tataatgaaaggggcgaaacatataagccgccccgagcctccgggtatttaaaaaaagctctttgtgaaaaaaaaaaactggagctcaccgcggtggcggccgctctagaactagtggatcccccgggctgcaggaattcgtctcacccctagaaaaaaagggcccatgctttctctgtctaaggattcatcttcctctcgtcttccctcttcctctccgaggatacaaggcgccgtcccaggtataggtagggtccctaccgtgctggaggagctgctcatcttcacccggggcggcctcatcctgtggtcgtcttgctgggcgctcagagccacagccctcagaggctcccccatcaacgctctcatccgctcctgtgtcctcgaggagcgatccgccgacaccagcttctcccaggacaattacgcgctcaagtggacctaccacaacgacgacggccttgtcatcatcgccgtataccaaaagatactccagctcctctacgtcgacgatgctcctccgccaccgtctcgcaagggatttctcccaggatctcccaaccccccaagcgccacactcctttgcgaaggaccttttgggggaaccatcttttccgtggcagggtttcccccccggcggaagggaccaaagggctcgttgtcgccccctataggaaaatatggagaagtgaaaagggtccccaaagagcacagggggacaccaattcgtactgtgttcccccgggtgtgccacaaaccggggcgcccttgtgggcccttctgttcctaccccccccgcggaaaaaagaaacaaagccccccatgggagtatccccaccaaaagagcgggggccccccgggcgggcacacggggggggaatattttccccccccccttgggggcgcgggagcgccccttgggcgtttataaaacaagaggggggccgcggtgcttccttgtggggtgcccccctaggagaggaagtggcaccctccctggaaaagatggggtgaaaccaggggctttattgtgggacaccaccctccggggaacccacatcgccggtgtatatgttagggggccacaacagggggtgtgcctctttctaaaggggagccccgaataaaaacattgggcgggttttctttcacgggtgaggaaattttttttct

SEQ ID NO: 89530 - DNA, 766 bp, Zea mays
  misc_feature: Ceres CLONE 1577232
  misc_feature: Encodes the peptide sequence at SEQ ID NO. 89531
  misc_feature (689)..(689): n is a, c, t, g, unknown, or other
  misc_feature (690)..(690): n is a, c, t, g, unknown, or other
ggagctccccgcggtggcggccgctctagaactagtggatcccccgggctgcaggaattcgtctcacccctagaaaaaatatgctagatacaaaagtttcaatgaagtgatgaagctattccatgatatggttgccagttgtgtaaatctggacaaggtgactgctgttaccttgatttctgcggccacaggtaagggatcactgaatcatgcaaagagtgtccacggttgggtagtgaaagaatttgaccatcaggatgcttttttggcgtcggctcttgtagacatgtattgcaaatgtggaaatgttaaaacagcttactatgtgttcgagaaagccttggacaaagatgttaccttgtggacagctatgatctctggccttgcattcaatggccatggaactgaagcattggaactattttgcaagatgcaaactgaggtcgtagcaccctaatggtgtcacatttgcttgctgttctcagtgcatgcagccatttctggcctgccggaagaaaagatttaaaaattttttgatgcccttgaaaccaaaaaatccccgtttttaaaccccgggaaataaaaacttttttgggggggatataggggtaaaaaacccccttttccacggggtaaaagggtgagcgccccaaaaataaaaaacctttttaaaccctttttggggagannagaagaaaaaaaaaatccccccccttatttagaatggggcggccacaaccgggcgggggtgctcctttttatttgg

SEQ ID NO: 89531 - protein, 115 aa, Zea mays
  misc_feature: Ceres CLONE 1577232
MKLFHDMVASCVNLDKVTAVTLISAATGKGSLNHAKSVHGWVVKEFDHQDAFLASALVDMYCKCGNVKTAYYVFEKALDKDVTLWTAMISGLAFNGHGTEALELFCKMQTEVVAP

SEQ ID NO: 89532 - DNA, 932 bp, Zea mays
  misc_feature: Ceres CLONE 1577233
cggccgctctagaactagtggatcccccgggctgcaggaattcgtctcacccctagaaaaaatctcccatcccatgatcaagattagccgaccacccgccgaaggccagagagaaatatctcatcttctctccaacggatcagttcactcgagagcgagggagatagggaggtgttgcttctatgggggccaacaccttccccgtttggagccaaatagggatatcagctgcttcgcgcaccacccctgctctgacgactctcgatgccaagacagcctcggcgtcttcttcttcttcctctcgattcccaagcctaccaccagctatagttagtctgcatgtgatggaacacaccgtcgcgtgtccagtgcaggtcgtgtttgtgtgtcccctggccccttttgcgtttttagtcggaggaccgatttccttgaacgttgccttactataaggccctccaaaggtgatatcctgggggcctggaccggggattaccaacggtgtctcaaaatatgggagggcctttttgggtactccaacatttccatgaaggccgagttgccatggttcacccttccaagcacgcttgattgtggtcaaccttaaagggttggaccagtcctcctgggacggttctagtagcttccccccgggggtgccctcttccacacaattgttgcgagtataaaagggtggaacgggtttttttgggcaatccgaggaatattcctccattttccccgcgggccggaatttccttgccgggagaaagctccgatttgtggattgcccccaaatttttataattgggaaaggcgctccatggggctgacgaaaaagtatggggggcaaatataaaaaatcccacgtgggttactcactttggaaagaagccttcgctttggttagtgaaacactattaattttcaaa

SEQ ID NO: 89533 - DNA, 874 bp, Zea mays
  misc_feature: Ceres CLONE 1577234
  misc_feature: Encodes the peptide sequence at SEQ ID NO. 89534
  misc_feature (506)..(506): n is a, c, t, g, unknown, or other
ggccgctctagaactagtggatcccccgggctgcaggaattcgtctcacccctagaaaaaacccgtgccgtggcccgtggtgggattggcggcaaagcaagcgggggcgatctgacagagagatgggagaaattacgcatcgataagaaccaaccgccgcaaccagcagccagaccaaccctacccgcgcgcccatccccctccccgtcctcgcccgcgtcatcgacccggcacccccttctcgatcttcccctccacctcgtcacgccgcacgagcccggcccaaataccctcgcgctcccacctctcgcactccacaaaccctaagcctagctcggtgccgccaccggtcccctatagtccgtgtttgccaccgcacccgcggggcaccgaagttggctggcacggaggtcacttggtctggagttaaatgcgtgttgtaatggaggggctcagcaccactgatgctgtgatcaagaagccaaggagtgttgcattcatgaagncaaggtccatgaagcagctcacggttgagtgcaatggcatttgcctgccatctcggagtgcttgtcatgacgatgacactggcatcgaagttggtgggcagcggaagaaacagctacacgaaaatagccctgaaatgaagggcttcatgactcacaggactgacttgcccagtaagataaaaagggatgataaatctggacgtgaccatgagggtcatgggtccgaacctgaaaactcaggggtgcctcccaaccatggaaagtgaaagggtttccattcccctggaagtgcacacccaagaaaacctatgaaatccccgttgaaaaaaacccccctgttggggctccccacgaaatattagattctg

SEQ ID NO: 89534 - protein, 109 aa, Zea mays
  misc_feature: Ceres CLONE 1577234
  misc_feature (22)..(22): Xaa is any aa, unknown, or other
MEGLSTTDAVIKKPRSVAFMKXRSMKQLTVECNGICLPSRSACHDDDTGIEVGGQRKKQLHENSPEMKGFMTHRTDLPSKIKRDDKSGRDHEGHGSEPENSGVPPNHGK

SEQ ID NO: 89535 - DNA, 823 bp, Zea mays
  misc_feature: Ceres CLONE 1577235
  misc_feature: Encodes the peptide sequence at SEQ ID NO. 89536
ctccccgcggtggcggccgctctagaactagtggatcccccgggctgcaggaattcgtctcacccctagaaaaaatagaacggggttgcgaggtagcccaattctacagcactagtctttttcgtctcggtcgccatgtccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaa

SEQ ID NO: 89536 - protein, 137 aa, Zea mays
  misc_feature: Ceres CLONE 1577235
  misc_feature (28)..(137): Pfam Name: VWA Pfam Description: von Willebrand factor type A domain
  misc_feature: SWISSPROT Homolog: EC 6.6.1.1 Magnesium chelatase
MAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALQPGGNTNISDGLQTGLKVLADRKLSSGRVVGVMLMSDGQQ

SEQ ID NO: 89537 - DNA, 910 bp, Zea mays
  misc_feature: Ceres CLONE 1577237
  misc_feature: Encodes the peptide sequence at SEQ ID NO. 89538
  misc_feature (793)..(793): n is a, c, t, g, unknown, or other
ctccccgcggtggcggccgctctagaactagtggatcccccgggctgcaggaattcgtctcacccctagaaaaactcgtgttcttgttcgtctccgcctcaggcaaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagatccagcaaactgcaaagttgaagctgaagaatgtgatgcctacgaggaaggcaatgagcctgtagctatgatagaagaatctccgcctgatattgaggcagatggtgaggatggaaaaagcagcgactcatactgtagtatggagtgtactcaggttttgagaagtaagtctatgtacatcagctctgcaattctagctgcaaagagccctttcttttacaagcctttctcaaatggaatgaaagaatccgaccagagcatgncactctttagaattaatgctcagaggaaaagcgcttatggagcttcttagctttatgtatagcggcaaggtgacgacaaacagccaactgtcctgtgggaataatgatgatccctga

SEQ ID NO: 89538 - protein, 181 aa, Zea mays
  misc_feature: Ceres CLONE 1577237
  misc_feature (166)..(166): Xaa is any aa, unknown, or other
MDPDFSPASGGPSFEFAFNSVNFSDRVLRIEIVAGDDALGAKGATGEGCSSLADWACHRKRRREELRRDKESRKYMPDPANCKVEAEECDAYEEGNEPVAMIEESPPDIEADGEDGKSSDSYCSMECTQVLRSKSMYISSAILAAKSPFFYKPFSNGMKESDQSMXLFRINAQRKSAYGAS

SEQ ID NO: 89539 - DNA, 951 bp, Zea mays
  misc_feature: Ceres CLONE 1577241
  misc_feature: Encodes the peptide sequence at SEQ ID NO. 89540
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
ctggagctccccgcggtggcggccgctctagaactagtggatcccccgggctgcaggaattcgtctcacccctagaaaaaagctagtccatatgtttgcgtcgcggaccaccactccacaatacacaaagcggctgcggatgtgagtagtataaagaaagcgatgaggcgccaggccggtagccaaggatcgagtcgtttaattttctactaggagctagcagcgagcgggttatttgcaacgacggcatcgtcttggcgttggcgggcgtgtttggcaccatgggcgactactactacagccgccgctcgccgcacctcctcccggcggcggtgctggcgctgctcgccgtcgtcgtcgtcgtcgtcgcgagcagcagcctccggggtgcggcggcggcggcgggggcgggccggaatgtgatcacgcacatcaagggcttcgaaggccctctgcccttccacctcgagacagggtacgtggaggtggacgaggagcacggcgcgcggctcttctactacttcatcgagtcggagaggaacccggcggaggacccgctcatcctctggatcaccggtggccccggatgctccgcgctctctggactcctcttcgagatcggacccctcaagttcgatgtggcggggtacacggaagggttcccgcggctggtctacttcgaggattcatggaccaaggtgagcaacgtgatcttccttgacgcgccggtggggacaggcttctcctactcgcgggaggaagccggcctgaacgtgagcctgacggagtccgggcggcagcacacgtgttcctccgcaagtgggtggcggacacccccgagtcgcgtccacccgctgtaatcggcggcgactcattgtgnnnnnnnnnnnnnnnnnnnnnnnnnnnnnnnnnnnnnnnnnnnnnnnnnnnnnnnnnnnntnnnnnnnnnnt

SEQ ID NO: 89540 - protein, 192 aa, Zea mays
  misc_feature: Ceres CLONE 1577241
  misc_feature (53)..(193): Pfam Name: Peptidase_S10 Pfam Description: Serine carboxypeptidase
  misc_feature: SWISSPROT Homolog: EC 2.3.1.92 Sinapoylglucose--malate O-sinapoyltransferase
MGDYYYSRRSPHLLPAAVLALLAVVVVVVASSSLRGAAAAAGAGRNVITHIKGFEGPLPFHLETGYVEVDEEHGARLFYYFIESERNPAEDPLILWITGGPGCSALSGLLFEIGPLKFDVAGYTEGFPRLVYFEDSWTKVSNVIFLDAPVGTGFSYSREEAGLNVSLTESGRQHTCSSASGWRTPPSRVHPL

SEQ ID NO: 89541 - DNA, 805 bp, Zea mays
  misc_feature: Ceres CLONE 1577242
  misc_feature: Encodes the peptide sequence at SEQ ID NO. 89542
ccccgcggtggcggccgctctagaactagtggatcccccgggctgcaggaattcgtctcacccctagaaaaaaactatcattgcaaaagcaaagcacgcgatccaatttccctccatttctctagatctcgagttgctctgctacttcttttagattccttctttcgttcgggagagcgattctctagctggtggcaatggcgaagggcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggtgacgccgccaagaaccaggtggccatgaaccccaccaacaccgtcttcgatgccaagcggttgatcggcaggaggttctctgacccgtcagtgcagagtgacatgaagctatggccgttcaatgtcatccctggccctggtgacaagcccatgattgtagtctcctacaatggtgaggagaagcagttcgctgctgaagagatctcctccatggtgctcatcaagatgaaggagattgctgaagccgtactcggctctactatcaagaatgcagtggtgacagtgtctgcctatttcaacgactcgcagaggcaagccactagggacgccggtgtcatgggggggcctcaatgtgatgggtatcatccaacgaacccactggctgctgctaatagactacgggtcttgaccagacgggcgggcagctctgggcgaagaagaacggg

SEQ ID NO: 89542 - protein, 202 aa, Zea mays
  misc_feature: Ceres CLONE 1577242
  misc_feature (8)..(202): Pfam Name: HSP70 Pfam Description: Hsp70 protein
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFNVIPGPGDKPMIVVSYNGEEKQFAAEEISSMVLIKMKEIAEAVLGSTIKNAVVTVSAYFNDSQRQATRDAGVMGGPQCDGYHPTNPLAAANRLRVLTRRAGSSGRRRT

SEQ ID NO: 89543 - DNA, 811 bp, Zea mays
  misc_feature: Ceres CLONE 1577246
  misc_feature: Translation starting site: 244
  misc_feature: SWISSPROT Homolog: EC 3.2.1.4 Cellulase
ctccccgcggtggcggccgctctagaactagtggatcccccgggctgcaggaattcgtctcacccctagaaaaactccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaacagtacacgcaggcgctgcacaaggcgctcatgttcttcacgcgcaggcgatcccggtccgctgccgaagcacaacggcgtcagctgggagggcaattcctgcatgaaggatggggctctcgacagcaccgtccgcccggacctgggtcggaggcttctacgatgcggggggacgccatcaaggttcactaccccatggcctgggtcatgaacatgctccagctggagtggggatcgagtacag

SEQ ID NO: 89544 - DNA, 841 bp, Zea mays
  misc_feature: Ceres CLONE 1577248
ctggagctccccgcggtggcggccgctctagaactagtggatcccccgggctgcaggaattcgtctcacccctagaaaaaaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagcaatggagcggcggcggcggcggccaccgaggctgccgctccttgtgttcgtcttagttgccaccacttgccccctcgggagctcagcagggattggaagcttcggagtcggtgcggagagcaatggagcttcgtctagttttaggaccaggagtctgctgcagattggagacagaaacgaagatggcctatttcatctgccacatacacgggctctcacgcacaagagcagatctcatagaaaagttccaacacccgcaccagcaccagagtccgctccagcaccctcaccatccatgtctccaccggacagctcaccgtctccgtcaccacatggttcacacccaatgccacgccaatcaacttcacatcgtcatccatccataacacctccacatttggtcaggcctgggcctaggcaagatggaaatgatcctttggtttatactccagctcattctcggcataaacatttttggacaacctatggtttagttgcagcagggattgcggttttccttttggtatcagcagctagtattctctgcttccgagctaagaaatgggaaccgtaagccatgggcgacaggtctaagtggacattgcagaaa

SEQ ID NO: 89545 - DNA, 791 bp, Zea mays
  misc_feature: Ceres CLONE 1577250
  misc_feature: Encodes the peptide sequence at SEQ ID NO. 89546
gcggtggcggccgctctagaactagtggatcccccgggctgcaggaattcgtctcacccctagaaaaatttttctacgcgcccagtccaacttggccaccaaccaaaagccccaagctgcggcgagcaagcgggcatccccttccccagtccacggctgcacctgcacgcaccgccctaaacgtccacgcactcacgttaaggaacagagtccccgcacgcttctccgcaaccttcccagcactttcccctccgtctcccgcgcctggtctccgcctcccgcgcgcgcccgatgcagatgccgccgtcgcggccgatctgacgccatcggtcgccggccatgaggcctcgccgccgggccctcttcccgttgcacagcgcaggcgctggggcctgcggtgacccgtgggccgactgccagacaccaccgccggttcccagcactcctgattccggccctggcccttccccatcgctgcctccctatggcgatctaccgtgccctcccgttttgtcgccgtcgccgtcgcctgctcccgcgcataacggtaggaggaaccagggagggacgcagggatacggggccccacccggtgcaggcgaccacgaccgacggcacctcgtcaaatacgcgctcatcgccgccggggtgttcgccttcgtatgcctgatcctgctcggtgtctcggtggccgtgcggcgccggcaggtccggcggaagcgggaagcgctcctcgcaccgcctacccccgaggcgcggcgaaacttcggcgggcggcggcgggcacgaac

SEQ ID NO: 89546 - protein, 150 aa, Zea mays
  misc_feature: Ceres CLONE 1577250
MRPRRRALFPLHSAGAGACGDPWADCQTPPPVPSTPDSGPGPSPSLPPYGDLPCPPVLSPSPSPAPAHNGRRNQGGTQGYGAPPGAGDHDRRHLVKYALIAAGVFAFVCLILLGVSVAVRRRQVRRKREALLAPPTPEARRNFGGRRRAR

SEQ ID NO: 89547 - DNA, 939 bp, Zea mays
  misc_feature: Ceres CLONE 1577251
  misc_feature: Encodes the peptide sequence at SEQ ID NO. 89548
  misc_feature (835)..(835): n is a, c, t, g, unknown, or other
  misc_feature (879)..(879): n is a, c, t, g, unknown, or other
ctggagctccccgcggtggcggccgctctagaactagtggatcccccgggctgcaggaattcgtctcacccctagaaaaaacgcctacaccacgcctgcagagcagcaagacttgtggctaccagcctagctagctaccgccgcgatccactatcatcgctcgccgagtttcctgcggcggccggcgggcacctacatctcctctacctgactggctagtcattagcacagccagtacgtacgtgtagctcgcccggccggtgctcgacgacacagtgaattggcgacgcacgtaggaggccagcagctggggttggagatgaccatgccagtgaagctgactcctgcctccctctcgctgaaggcggtctgctgccgcttcagctccggcgagcatgcgctgcgcttcggctcgtcgctaccgtgctggaggaggacgccgacgcaacggagcacgtcgtcgtctacgacgcgctctgcggctgaggatagccctggcaaaagcaagcaacacgatcaagaagcatcggaggctacgataagacagcagctccagcaagtcgatgtgcttgagaacatggggatttctcggcattttcctggtgaaatcaaatgcatccttgacaggacatacagaagttggttacagaaacatgaggaaattatgctggacacaatgacctgtgcgatggcatttcgtattctaaggttgaatggatacaatgtctcttctgaatgagtgtatcatgttgttgaagcttccgggctccataattcacttggaggatatctcaatgatacaagaaccttgttagaattcacaaggcctcgacangtagtatctctgaagatgagtctatcctggatagcataggctcnaggtcacgtaccttactgagggacaacttagagtctggtggtgctctacgaaaacctccc

SEQ ID NO: 89548 - protein, 139 aa, Zea mays
  misc_feature: Ceres CLONE 1577251
  misc_feature: SWISSPROT Homolog: EC 4.2.3.19 Ent-kaurene synthase
MTMPVKLTPASLSLKAVCCRFSSGEHALRFGSSLPCWRRTPTQRSTSSSTTRSAAEDSPGKSKQHDQEASEATIRQQLQQVDVLENMGISRHFPGEIKCILDRTYRSWLQKHEEIMLDTMTCAMAFRILRLNGYNVSSE

SEQ ID NO: 89549 - DNA, 849 bp, Zea mays
  misc_feature: Ceres CLONE 1577255
  misc_feature: Encodes the peptide sequence at SEQ ID NO. 89550
  misc_feature (596)..(596): n is a, c, t, g, unknown, or other
  misc_feature (712)..(712): n is a, c, t, g, unknown, or other
ctggagctccccgcggtggcggccgctctagaactagtggatcccccgggctgcaggaattcgtctcacccctagaaaaaaccacccccatcctctctaacccacggaagcaaggcaaaaagcccgtgctggacgacatctcccctgtcgatccacgaccatgatgcagcagctccgtcacaaccagccgagcccgtgcctctgcggcctgcgggcggcacggcctatgctcgcgctcggcgcagcagcatcccgttcgcggcccgccggaaaactgcaaccgagcgcctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccgatcccgacgggcgcggggtgaaggcggaggcgtcggtgctggacgccgtcgtgggcagcgggaacagcgagctcgacgtggacctgatctgggacgaggcgctgggcgcgcccnggcgcggtggtggtgaagaaccactccgacttccccgtgtaccctgagctgctgagcgtgccggcccggcgtcggcggcgccgacgacgaggccgcccgccgtcacttcgcctgcnacgggaggggtgtactccgtcgacaagcacccgtaccgcctctttctcaccaacgacgcgtgcgtcaaggaagaaaacgcgagcgccctgctcaagtaccggggaggacgagctccgcgcgcctccgggaagacggc

SEQ ID NO: 89550 - protein, 160 aa, Zea mays
  misc_feature: Ceres CLONE 1577255
  misc_feature (146)..(146): Xaa is any aa, unknown, or other
MMQQLRHNQPSPCLCGLRAARPMLALGAAASRSRPAGKLQPSACLGLGHVAPAAARGQPRPRAVADSALGASPTSVHVGGKLLLQNFAADSQQRLKLSIQLVSATVADPDGRGVKAEASVLDAVVGSGNSELDVDLIWDEALGAPXRGGGEEPLRLPRVP

SEQ ID NO: 89551 - DNA, 1180 bp, Zea mays
  misc_feature: Ceres CLONE 1577260
  misc_feature: Encodes the peptide sequence at SEQ ID NO. 89552
  misc_feature (1)..(1): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (327)..(327): n is a, c, t, g, unknown, or other
  misc_feature (465)..(465): n is a, c, t, g, unknown, or other
ncccttcttttctctcgtctcctacacaccccaatctacaacccctttnnnnntnntttttttcaaaactggactccccgcggtggcggccgctctagaatagtggatcccccgggctgcaggaattcgtctcacccctagaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacagcggcggcttcnatgactactactgggacgacgacttccatttccacgacgacggcttctccgcctcccctacgacccccggcagcggtggtgcgccccgccagcaaccacacatgggtgatatttcagcctcggactagaaagaatgcnaacacatggaagggacacccccccgaaagactcaactacaccaggggaccagtaccgtcgagatgaggctcaaaagagtacaagagccgccccgaatcctcaccaaggtccgcacagcgggggctacggacaaccggggaatgcaaaacggggtgggagaaagaaagggaaacatttctacccaagttcccctcctgaaacaccctagaagcccgtcaataggccaaacgtaattgatggccaaatttcccacgggttacgggggttgcccaacaatcggggggaatttctttgcggggttccacccccccacccctgttatccctaagaaaacagctgtggtttttctctccgccataagggttattattgtaataacctggccccctctcttgttagttttaacacacccccctcggaatatttttgtgctttataaaccccccgcgggggaaactaccaccacatattttgcccactatcttgtgtaagataaaacacccccgcgccccgggtaaattgtggtcaccacccccttttggtcaaaggggcgggtgtaccatttaacaagtgtttcttcctccctgaggggggtataatatttgggaaaccctcatcttttcccccctacaaaataaaaaattttgtattggaagaaataagaaccccggaaaaaaaagagactccccagaaacgcttattgaagagggggtgg

SEQ ID NO: 89552 - protein, 61 aa, Zea mays
  misc_feature: Ceres CLONE 1577260
  misc_feature (20)..(20): Xaa is any aa, unknown, or other
MAHDLCEDLELVADDSGGFXDYYWDDDFHFHDDGFSASPTTPGSGGAPRQQPHMGDISASD

SEQ ID NO: 89553 - DNA, 782 bp, Zea mays
  misc_feature: Ceres CLONE 1577261
  misc_feature: Encodes the peptide sequence at SEQ ID NO. 89554
  misc_feature (657)..(657): n is a, c, t, g, unknown, or other
  misc_feature (658)..(658): n is a, c, t, g, unknown, or other
  misc_feature (690)..(690): n is a, c, t, g, unknown, or other
ctccccgcggtggcggccgctctagaactagtggatcccccgggctgcaggaattcgtctcacccctagaaaaacccgcgtcccccacctcatggcgccggcgatggggctgaagcggcctgcggcgggagcaggggcggcagcagcgcagaccgtcacgctgtccgcgcctgccgtgcgggacgcggtgcgcaccgccgtaagggaggccgaggccacggcgaaggctaccgccccggccgccagggtcccggcgacggcggcagtgccggcggagatcgctagggatggggtgctgtgcctggaggaggtcgacgggaggcggtggagctatgtggtcgacgccgccggcgccgcggtcaaggccaagggaagggcgtccgtcggcggcgccttcaaggccgtcccgctccagtccccgatgccgcccgtcgaggaaatcatgtcctttataagatcatatgttgtgcccgaaggctttccagatagtgtcacaccttcatatgttccatacatgacatggagagcattgaagcatttctttggtggagcaatggggtgtgtttacaacaaggaccttgctcaactctgtttggagtctcccaaagcagggctgcatctggtgctgtggctatcaactggattctcaaagatggnngctgggcgtgttggaaagatgctttttgcccngccaggggaagaaatttgattatgacctgaagcagctaccctttttctggtgatctccttgatgaatttaggacctggggatagaaattacc

SEQ ID NO: 89554 - protein, 205 aa, Zea mays
  misc_feature: Ceres CLONE 1577261
  misc_feature (189)..(189): Xaa is any aa, unknown, or other
  misc_feature (200)..(200): Xaa is any aa, unknown, or other
MAPAMGLKRPAAGAGAAAAQTVTLSAPAVRDAVRTAVREAEATAKATAPAARVPATAAVPAEIARDGVLCLEEVDGRRWSYVVDAAGAAVKAKGRASVGGAFKAVPLQSPMPPVEEIMSFIRSYVVPEGFPDSVTPSYVPYMTWRALKHFFGGAMGCVYNKDLAQLCLESPKAGLHLVLWLSTGFSKMXAGRVGKMLFAXPGEEI

SEQ ID NO: 89555 - DNA, 828 bp, Zea mays
  misc_feature: Ceres CLONE 1577262
  misc_feature: Encodes the peptide sequence at SEQ ID NO. 89556
  misc_feature (786)..(786): n is a, c, t, g, unknown, or other
  misc_feature (801)..(801): n is a, c, t, g, unknown, or other
  misc_feature (802)..(802): n is a, c, t, g, unknown, or other
ggagctccccgcggtggcggccgctctagaactagtggatcccccgggctgcaggaattcgtctcacccctagaaaaaaagaagagattatcgctcacagcatgcaaaacagaacaatctcctctccgaattcaatcatccctccgccgcaccactcttcctccgcctctgctccgcttctgcactcagcgtcctccggttgctgacggatccctcttcgccgccgccgccgcggacccaccgtgggagaggaggcgatgcgaggcgaggaggcgggagcgatggaggccgccgactacgggaagctcttcgtcggcggcatctcatgggagacgagcgaggaccgcctccgcgagtacttcggccgcttcggcgaggtcaccgaggctgccatcatgcgggaccgcagcacggggcgtgcccgcgggttcgggttcgtggtcttcaccgacgcagcggtcgccgagcgcgtcaccatggagaaacatatgatcgacggacgaatggtggaagcaaagaaggctgttcccagagacgaccacagtattgtgagcaagagcaatggcagaagcacagggtcacctggaccgggacgcactaggaagatctttgttggaggcctgccctcgagcatcacggaggctgacttcaggaggtattttgagcagttcggtgtcataactgatgtgggttgtgatgtatgatcacaacacgcagagaccgaggggctttggattcatcacctatgattcatcacctatgtacctggggtcatatgaccccttntttccctctactttnnataatggccacctgctcaaaactcaa

SEQ ID NO: 89556 - protein, 140 aa, Zea mays
  misc_feature: Ceres CLONE 1577262
  misc_feature (9)..(78): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEAADYGKLFVGGISWETSEDRLREYFGRFGEVTEAAIMRDRSTGRARGFGFVVFTDAAVAERVTMEKHMIDGRMVEAKKAVPRDDHSIVSKSNGRSTGSPGPGRTRKIFVGGLPSSITEADFRRYFEQFGVITDVGCDV

SEQ ID NO: 89557 - DNA, 981 bp, Zea mays
  misc_feature: Ceres CLONE 1577267
  misc_feature: Translation starting site: 158
  misc_feature (492)..(492): n is a, c, t, g, unknown, or other
  misc_feature (550)..(550): n is a, c, t, g, unknown, or other
ctccccgcggtggcggccgctctagaactagtggatcccccgggctgcaggaattcgtctcacccctagaaaaaattttttttctattcccatttccaccctcgcaccgcatccacctccaccgcgccgccgcgagagaggggaaggagggtttccgatggagaacggcgaggagacgttcgcctcccccactgccgccgccgccgcggacttcgagatctccatcaacggcggggacagcacgcccaagctccacaatttggcggacgagatggaggccctccgcgcggcgaagcgcgacctggaggagaagctcgatgccgtgggacacgagaaccggttcctgtcctctgagtcccggcgcctcgaggtcctcgtgtcccaggcccgcgagggagtcgccgctgccgagcaagtcgccgccaccaacgagagcgaggccgccacgctccgcgcccgaggtcgagcgtctccaggggcctcttagccgcngtagaaggccagccctgagggagaaaatgccccaggggccccaggctccggggaccanctgcaaacgggcgtcccaggaaaggcccccccttggggaggaaatccagaccctgaggggttccccccctcccaaggaaggggcgggaaaggagaaaaaaagagaccttttttcccttttgcccggggcggggaccccaaggggaagggcggggggcccccctcctttggggtgcccccgttgtggaaaaattccccgggggccacccggggggggtctgccccccccaaaaaattggggggcgcccacaccccggaaaattttttccccccctgggcccttgggggaaaaaatttggggggcgcccggggggtttttcctccccgcggggatttttgtggggggaaaaccccttgtggggggctttttttttcccggctcccccccccaaggggggcccccaacaaaaaaaaaaaacgcccggcctgtgg

SEQ ID NO: 89558 - DNA, 891 bp, Zea mays
  misc_feature: Ceres CLONE 1577268
  misc_feature: Encodes the peptide sequence at SEQ ID NO. 89559
aagctggagctccccgcggtggcggccgctctagaactagtggatcccccgggctgcaggaattcgtctcacccctagaaaaagcagttggtcgaaaaaaaaagtggaaaggaaaggggcaaaatatcctagggttctgcctccatggacatcgagacccacgccgccgccctggcccgcgacgagctgcggcggctcctggccgccaccctcagccccgacaaggcgtcggttgacgctgccgcggcggggctcgacgcgctctcttccgacccacgcttccccctcgccatcctcgccgtcgctgcaggggacggtgatcaggggatgagagtcgctgcagcgacatacttgaaaaattttacccgccgcaatttggaaacccgtctgtgttcatctcccccttacaaggagttccgtgaccaacttgcccaggctttgcttcgagtggagcctgcaattcttcgagtgctgattgaagttttccgccaagttgttgaaaaagattttgtcaaggataacttgtggcctgagcttatccctcagttgaaactagtgatccagagcagcaatctaattagtccaggccagcatcctgagtgcaatactattaatgcactcacagtactttcatctgttgtaaggcccctccagtatttcttgaatccaaaagttgtgaaaagagcctgttcacaacagttggagcaaaatgcagccgagattcttgtaccattgcaagtgacttccctcacttctctggacagggtctttttgtcacctgatgggactaactttggatatgagcagctcccactcatcacaggcaatgcctgtatttccctggggaggcatacatgcccatctaggggggaaacaaattttgcctttctt

SEQ ID NO: 89559 - protein, 249 aa, Zea mays
  misc_feature: Ceres CLONE 1577268
MDIETHAAALARDELRRLLAATLSPDKASVDAAAAGLDALSSDPRFPLAILAVAAGDGDQGMRVAAATYLKNFTRRNLETRLCSSPPYKEFRDQLAQALLRVEPAILRVLIEVFRQVVEKDFVKDNLWPELIPQLKLVIQSSNLISPGQHPECNTINALTVLSSVVRPLQYFLNPKVVKRACSQQLEQNAAEILVPLQVTSLTSLDRVFLSPDGTNFGYEQLPLITGNACISLGRHTCPSRGETNFAFL

SEQ ID NO: 89560 - DNA, 1025 bp, Zea mays
  misc_feature: Ceres CLONE 1577272
  misc_feature (1025)..(1025): n is a, c, t, g, unknown, or other
ccccgcggtggcggccgctctagaactagtggatcccccgggctgcaggaattcgtctcacccctagaaaaaaaaaccctaccacgtctcataaccctcgcgaatcgtcatttccgctctctgccacgccggagcccccactgcccaccacccgttcccgcggcctcgccctttgcgtggttgaagaagcgaaagatgctcggggcctctaggcgatccctcagtgccgccgccgcgcgcccgcagccgcgtggctgccggcgctgcctccgccgtctccgccgacgccgccgcctcaatcccgccccgacccgcgagcaatggagcgccaggggttcatcagcaccagaaaacgctgctctcagtgcttgtagcgcccaaggttgcaccacccaccaatgttgtgtccctcaagccgatgggtggtgcccttactgggagacgcaatgaatccagtgcggcagcagttgactccacgggacccgccagctgagaaacatgattaccaagggtgaaggtcaacaggctccatggatttggatcgaacaccgcgtggtatagaaaaacaagaaagttctccctttcgagaactgggcccagcaatggcttgtggagggcccttagaataaatagcggtttaccctgagggggttccgggatcctggaggcttccttgaaagaaggggtccccccaaccttggagttttgccccctccccaaactgtgaccaaggcatatgtgggaaacaacatacccatttacctgtttctctggggacttgggatttacctaaaacaagagaaccttttggatttccctttggggacttttgccagcatgggggaaatggccagatttcccgaaagcgttttatgggagagcgcggataaggtgtgatgggaaaacactctttgttggccaaatggggggtggggttatatcccaaagtttttgttatgagaagagtgttttgctccagtgcgcgcaattgccaaaaaccgcttgtgggaaaaacaaaatattgn

SEQ ID NO: 89561 - DNA, 874 bp, Zea mays
  misc_feature: Ceres CLONE 1577273
  misc_feature: Encodes the peptide sequence at SEQ ID NO. 89562
ggagctccccgcggtggcggccgctctagaactagtggatcccccgggctgcaggaattcgtctcacccctagaaaaaaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatctttggtgctgccacttcagcataccaaattgaaggggcttggaacgaaggtggaaaggggccaagcacttgggacgacttctgccacaaccatccggagtggatagcggacgggagcagtggggatgttggagcaaactcctactatctgtatagggaggacgtcacattgctgaaggaaatgggtatggacgcctacaggttctccatctctttggccagaatattgccaaaggggacactccagggaggcatttaccctaaaggcatcgaggactaccaaaagctgatcaacttgtttgaaagaaacggcctagaaccatatgtgacactttttccctggggaacacctccaagccccggggggacgcctaccgggggcttccttttaagaaaaggaattgtaaaaaacataccaaaactttctcccaaggggggcgctttgtggccccctcccgggaaaaaccttggaaaaaaaagggttta

SEQ ID NO: 89562 - protein, 243 aa, Zea mays
  misc_feature: Ceres CLONE 1577273
  misc_feature (73)..(240): Pfam Name: Glyco_hydro_1 Pfam Description: Glycosyl hydrolase family 1
  misc_feature: SWISSPROT Homolog: EC 3.2.1.21 Beta-glucosidase
MAPLLLASRTACRPGLTSRHAHDNGRHGLSSSPPGSRSKRSRSLSLRPRAEKTTTGGGGHVVSEKLSPWQIPRREWFPPSFIFGAATSAYQIEGAWNEGGKGPSTWDDFCHNHPEWIADGSSGDVGANSYYLYREDVTLLKEMGMDAYRFSISLARILPKGTLQGGIYPKGIEDYQKLINLFERNGLEPYVTLFPWGTPPSPGGTPTGGFLLRKGIVKNIPKLSPKGGALWPPPGKNLGKKRV

SEQ ID NO: 89563 - DNA, 1073 bp, Zea mays
  misc_feature: Ceres CLONE 1577278
  misc_feature: Encodes the peptide sequence at SEQ ID NO. 89564
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (990)..(990): n is a, c, t, g, unknown, or other
  misc_feature (1055)..(1055): n is a, c, t, g, unknown, or other
agggtaggtagagaagcaaaaaaaaaacacgacggttggcaggagaggaatcttnnnnnnnnnccannnnnnnaaaagctggaactccccgcggtggcggccgctctagaactagtggatcccccgggctgcaggaattcgtctcaccccctagaaaaacccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggagggggcgctggcgcccctcggcggctcttcctggaggagctaccctgggaccattccttcgtccgcgagctgcctggcgaccctcgatccgacaccccccccccggaggtcctggacgccctggtactccaggggggctccctcctgcccaagggggacaacccccacgccggggcgccgcggggctgattcccgcgggccccattccctccatcccgggctcccaaaaaaaccttcgaaaagaaccggatattccccccaaatttttttttcggggggcaaaccccccccaaattggggggaagatttgcgccgcctacccccccaaacgctcttttcgcgaggaacatcctgccattccagattttacacgggaccgggcgccaagttgtgacggggaacaggaataaaaacgcaaatatctcccccccccacacaaatgcggcgaaaattactttcaatgatggagaggaaaagaggaaagtttgaacccttccgacgaaacctctgtggtaagaaacagcacgacacggcgcacatgacccctgaaaggggggcgagtcaacgacgtgacgggcgacagacacttgcaaggcaacatctnatacactaacacggcacgctactctatgaggtggggggtggctcggaaactccgcggtgtgcaanttttcgcgagcagaaagg

SEQ ID NO: 89564 - protein, 84 aa, Zea mays
  misc_feature: Ceres CLONE 1577278
MASAAAPGSHAAAEAPPVDVGGGGAGAPRRLFLEELPWDHSFVRELPGDPRSDTPPPEVLDALVLQGGSLLPKGDNPHAGAPRG

SEQ ID NO: 89565 - DNA, 962 bp, Zea mays
  misc_feature: Ceres CLONE 1577281
  misc_feature: Encodes the peptide sequence at SEQ ID NO. 89566
  misc_feature (918)..(918): n is a, c, t, g, unknown, or other
ggagctccccgcggtggcggccgctctagaactagtggatcccccgggctgcaggaattcgtctcacccctagaaaaactctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaagactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacaagctccggtccgacgtcatcttccacgtctcccagaccggcgggcacctcgggtccagcctcggcgtggtggagctcaccgtcgcgctgcactacgtcctcaacgcgccccaaggacgcatcctcttgggacgcgggccacccatcgtatccccccaaagatccttacgggggcggggcgcacaagatgcccaacaaatgcggcaaaaacaaaggccctgggggggggtttcccaagcgccccggagaaacgatataaaaaacttttggggaggggcaccagcttccccccccatcttcccccgggcctcgggaaaggggggtggggccggggaccccaaggagggggcgagaaccaacntgggtcccgggtgatattagaacagggcctttatcaggcggggg

SEQ ID NO: 89566 - protein, 218 aa, Zea mays
  misc_feature: Ceres CLONE 1577281
  misc_feature: SWISSPROT Homolog: EC 2.2.1.7 1-deoxy-D-xylulose-5-phosphate synthase
  misc_feature: The sequence is a functional homolog of SEQ ID NO 12 in US patent 7132250
  misc_feature (215)..(215): Xaa is any aa, unknown, or other
MALSTFSVPRGFLGVPAQDSHFASAVELHVNKLLQARPINLKPRRRPACVSASLSSEREAEYYSQRPPTPLLDTINYPVHMKNLSVKELRQLADKLRSDVIFHVSQTGGHLGSSLGVVELTVALHYVLNAPQGRILLGRGPPIVSPQRSLRGRGAQDAQQMRQKQRPWGGVSQAPRRNDIKNFWGGAPASPPIFPRASGKGGGAGDPKEGARTNXGPG

SEQ ID NO: 89567 - DNA, 822 bp, Zea mays
  misc_feature: Ceres CLONE 1577283
  misc_feature: Translation starting site: 246
  misc_feature: SWISSPROT Homolog: EC 5.2.1.8 Peptidylprolyl isomerase
  misc_feature (775)..(775): n is a, c, t, g, unknown, or other
  misc_feature (801)..(801): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
ggagctccccgcggtggcggccgctctagaactagtggatcccccgggctgcaggaattcgtctcacccctagaaaaattgacaagacaatagacaataaaacccttcatgagaccttttcttcatttggtaccattctctcatgtaaggtagccgtggatgaagcaggccaatccaaaggctttggttttgttcagtatgacaaagaagaagctgcgcagaacgctataaaaagtcttaacgggatgcttataaatgataagcctgtttttgttggaccttttgttcgcaagcaagaaagagatcattcttttgacaagacaaaatttaacaatgtctttgtgaaaaatttgtctgagtctaccacaaaggaagatttactcaaaatctttggtgaatatggggatattacaagtgctgttgtgatgattggtatgggatggtaaatcaaggtgctttggtttcatcaattttgagaatccagatgcagcttcccgtgctgttcaggaacttaatggtaagaagataaatgacaaagagtggtatgttggaagagctcagaagaagtcagaaagagagatggatctaaaaaggagatttgagcaaagcttgaaagatgctgctgacaaatatcagagattctaactgaaactgaaacattgatgtcactgaatctcacagactacatgctcagctgattgctcaccggactccgtacgaatgatatcgaaactgttgctcagcaatgagattagcattaagctgtaagacatcnctagcgcatgacaccatatagctttntcctttagnnnnnnnnnnnng

SEQ ID NO: 89568 - DNA, 1101 bp, Zea mays
  misc_feature: Ceres CLONE 1577284
  misc_feature: Encodes the peptide sequence at SEQ ID NO. 89569
  misc_feature (18)..(18): n is a, c, t, g, unknown, or other
  misc_feature (94)..(94): n is a, c, t, g, unknown, or other
gtcacctggtggccgggngtcgcggggttcattttagaaagaaagggcgtgatgcggtttaaaaatgttttttttttaaaactggtactccccncggtggcggccgctctagaactagtggatcccccgggctgcaggaattcgtctcacccctagaaaaagtcccccaagcatcaagctaggcaggcctggtcccgaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcagcacgctggccggggcagctcttccttcggctggactgggcgacaagctgggggcgcaagaagcgtgtacggggatgacgcctccatgggtcatgggtcattctgctcccgtctcgatcagggtcctcttcgtttcgggccacaaccacccaacgggggggttcatggggccaacagcttctggcattacatttaccgcttttccgggagactccaggcctttctcgggtcaatctcgggctgggactaacatttaaccccctgcgatatgttccggggtcccacacccacatctaataggatgtcgcgcaatagttaacccgtccccctaacccaaagataggggaactcccggggcgggtgcggggctttaacaattacgtgtccgtaccactttctcttttctccaccatatgggcacaaggtgagatcttgcgtgggcaatgccccctcccatccccgggccagggaccatttattcatacaaaggccatcaggatcaatttgtgcacaacgcacggatcttttacccatggaagccagaagtttaacccacatgtcccccatgagcggtataaaaaggggtgaacaacaccctcttgtacgccgcccacag

SEQ ID NO: 89569 - protein, 166 aa, Zea mays
  misc_feature: Ceres CLONE 1577284
MARGGDGLQVLSALDAAKTQWYHFTAIIVAGMGFFTDAYDLFCISLVTKLLGRIYYTDTSKDSPGSLPPNVAAAVNGVAFCSTLAGAALPSAGLGDKLGAQEACTGMTPPWVMGHSAPVSIRVLFVSGHNHPTGGFMGPTASGITFTAFPGDSRPFSGQSRAGTNI

SEQ ID NO: 89570 - DNA, 741 bp, Zea mays
  misc_feature: Ceres CLONE 1577286
  misc_feature (663)..(663): n is a, c, t, g, unknown, or other
tcccgcggtggcggccgctctgaatagtggatccccgggctgcaggattcgtctccccctagaaaaatgccttaacccaacatttatctgtatcccgtggcaaggagcatctgcgcgtcacatccgcagatcgcgcgctctacgtcgcctcccgccgccagcgcacggccgcgacggatgctcggcctccgctttccctaccggccctgcgcccttcccaaatgggttctgcctgctgaagaaggaaccttctgggcccggcctggggccggaccattcggggcccggggggccaacgccggagagggccccccccccggggggggttctcttttcccccctttccggggggggggggggcctttgtggcccccccgtggggggaagggcgcctcccggggggggggggttgccccctgggggggggggggggggccggggggccccccccccaccgaatcttttccccgacaaaaacaaaaaaagggggggggttttagtgccacaactctttgtggggggtatattcccccacttatggtccccccgggggggggcccccccttcccccctatattgaaattcacattgcgtggtgtggggaaaaaatacaccgcgcgccggggctcctgcaccaccccgttttgtttttttttttacccntccccctttgtctgcgtgtggcttttttttttttgattgggtgggcggggggggccgcgcctcatcgggggggggggg

SEQ ID NO: 89571 - DNA, 827 bp, Zea mays
  misc_feature: Ceres CLONE 1577288
  misc_feature: Encodes the peptide sequence at SEQ ID NO. 89572
  misc_feature (684)..(684): n is a, c, t, g, unknown, or other
  misc_feature (685)..(685): n is a, c, t, g, unknown, or other
  misc_feature (693)..(693): n is a, c, t, g, unknown, or other
  misc_feature (694)..(694): n is a, c, t, g, unknown, or other
ggagctccccgcggtggcggccgctctagaactagtggatcccccgggctgcaggaattcgtctcacccctagaaaaaaccgaaccaaaccaacacacgtcaaagcagaaaacctcagaaaaccccaatatatcctcgtccaccactgcccccgctctgctgcaactccactcggcccggccgccctttccacccaccttgatcctccgatccgttggtgcttgaccgatccatggacacccacatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgacgtcttcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggccccactccaacgactacgggaacaaacnngcatcttnnacacacatcggtctccccggacttctcgcaagagctccgctgctttccagaccgtcacctgccatcaggcgggggggaaacaatctgggatgacgcgcacgagcagatcgacacggccattgccacggcacta

SEQ ID NO: 89572 - protein, 184 aa, Zea mays
  misc_feature: Ceres CLONE 1577288
  misc_feature (44)..(180): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
  misc_feature (151)..(151): Xaa is any aa, unknown, or other
  misc_feature (154)..(154): Xaa is any aa, unknown, or other
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPHSNDYGNKXASXTHIGLPGLLARAPLLSRPSPAIRRGGNNLG

SEQ ID NO: 89573 - DNA, 789 bp, Zea mays
  misc_feature: Ceres CLONE 1577289
  misc_feature: Translation starting site: 324
  misc_feature: SWISSPROT Homolog: EC 2.7.11.1 Non-specific serine/threonine protein kinase
  misc_feature (765)..(765): n is a, c, t, g, unknown, or other
tccccgcggtggcggccgctctagaactagtggatcccccgggctgcaggaattcgtctcacccctagaaaaaacatacacacgcgcacagccgcactcggttccagctacagagaattcgtccaggaaagtaaaaaaactcccccattcgcgagggacagaaggagggaggagtcaccgcgtgagctcaggaggaagagggagaaggagaggccgccggcggcggcgcggcagaccgggaaccgccgtgtagcactggggtggtggacccgcgcgcccatgcgtcggtgaggtggtggggcccgcttggcgctcgagttggaatggcggcggcagggaggtggtgggcggtggtccttgcggtcgcggtgctgctcgggccgggccgggtcgtcgccaacaccgagggcgatgctctatacagcctgcggcagagcttgatagatacgaacaatgtcttgcagagttgggattccactcttgttaatccatgtacatggtttcacgttacgtgtaacagcgataacagtgttatcagagttgaccttggaaatgcacaattatctggcgtcctagtgccacagcttggtcagctgaaaatctccaatatttggagctttcagcaacaaaataagtggggcaataccccctgaactggggaacctgactaaccttgtcagtttggatctgtatatgaaacacttctctggcaatatccctgacagccctaggtatctatttgagctgcgtttcctacgtcttaancacaacagcttgggttggtccatt

SEQ ID NO: 89574 - DNA, 886 bp, Zea mays
  misc_feature: Ceres CLONE 1577290
  misc_feature: Encodes the peptide sequence at SEQ ID NO. 89575
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (637)..(637): n is a, c, t, g, unknown, or other
  misc_feature (699)..(699): n is a, c, t, g, unknown, or other
  misc_feature (707)..(707): n is a, c, t, g, unknown, or other
  misc_feature (709)..(709): n is a, c, t, g, unknown, or other
  misc_feature (736)..(736): n is a, c, t, g, unknown, or other
  misc_feature (747)..(747): n is a, c, t, g, unknown, or other
  misc_feature (756)..(756): n is a, c, t, g, unknown, or other
  misc_feature (761)..(761): n is a, c, t, g, unknown, or other
  misc_feature (821)..(821): n is a, c, t, g, unknown, or other
  misc_feature (864)..(864): n is a, c, t, g, unknown, or other
ggagctccccgcggtggcggccgctctagaactagtggatcccccgggctgcaggaattcgtctcacccctagaaaaactcgcgggcagaaggcaaacgcggctgcgagcgcggcgcccctctcccactccccagccgccgccagcccgcacacccctccctcgcgcgctcagggtttcggaatggaagccgaggcggcggccaagaggacgcgggagagcggggaggacgccgccgcggcggggatctccgccgtcatcccgggatggttctccgagatcagccccatgtggcccggtgaggcgcactctttgaaggtggagaaggtgctcgttccaaggggaagtcaggactacccaaaacggttatgggtcttttcaggtcccttctaccttacggggaaaggtgggctcggtccccttgaatgggaagtttattttccggggtttaccgggaaaaaagggaaattaaattggtggcccgttcccccagggggggaggggatttaaactttcacccccggggcccccccttttttgtggccccccccctttcgagaaaaagaaaactccccccggnnnnnnnnnnaaaaaaaaagggggggtgttttgtggggggtttggttttttttttccgnaaaggagggggggggcgggaggtggtataagtcggggtggggggggggggggaacttgtttntcacaccncntgcccaggggaaggggaagggagtatntatatcaacgnagttttttntgggntttctttacaattcctacgggggggagggggaaaattcaaactaacaataacccccgggngggggacggtcgtgaaaaaacagcccacatcaatacacgcggngatgtgttaaaaactacaaaat

SEQ ID NO: 89575 - protein, 108 aa, Zea mays
  misc_feature: Ceres CLONE 1577290
  misc_feature: SWISSPROT Homolog: EC 2.5.1.16 Spermidine synthase
MEAEAAAKRTRESGEDAAAAGISAVIPGWFSEISPMWPGEAHSLKVEKVLVPRGSQDYPKRLWVFSGPFYLTGKGGLGPLEWEVYFPGFTGKKGKLNWWPVPPGGEGI

SEQ ID NO: 89576 - DNA, 867 bp, Zea mays
  misc_feature: Ceres CLONE 1577292
  misc_feature: Encodes the peptide sequence at SEQ ID NO. 89577
  misc_feature (592)..(592): n is a, c, t, g, unknown, or other
ctccccgcggtggcggccgctctagaactagtggatcccccgggctgcaggaattcgtctcacccctagaaaaaatcgctgctccattctccatgactgttctggaagctccaagcgttggcgaaaaaagtaagatatttctgcgaggcaaggaatccctcccccgcttctactctttcggttcgccggttcgccgtctcgcacacccacttcctacaccgccaccgagcactcgctcagtttcatacccatcctcgaagtcgcctctgtctagttcctgctcttccaccaccgcctgtgatgtatccccgaggcccggatgggggacgagatgcctcgtctcgccctatgcttgccactcccgccggcaacgacacgcgcgaggaggatgagatcaccaccgcggaggctcatgtggagaaagacgccgcgcggatggacgctgccctcctcatgcggactacgcccaagatggacgagtttcacaccgggggcgatctggactcaactggaagtggaagcggcatctcggggccaagcgcctccaaaagacagctacaaagaaggggatcgtggcggcaacgagtcagcnaggtcagcatccatggctatccttttcctttgggtttctatttgaactgtttttttgcccgcgccagcaacaagaagaatgtggtcgttggctgtattgggtccaccgggacaccatccaccctcacccatttccttggggtttccggttggaaccatttttttaaaattcctttatcaatttgaataggaacccccttgcacccgcccaaaatttgaatccggttccgttgaaagggcccaaaaataacagtgggttccaaaaacacttttgaa

SEQ ID NO: 89577 - protein, 158 aa, Zea mays
  misc_feature: Ceres CLONE 1577292
  misc_feature (98)..(98): Xaa is any aa, unknown, or other
MYPRGPDGGRDASSRPMLATPAGNDTREEDEITTAEAHVEKDAARMDAALLMRTTPKMDEFHTGGDLDSTGSGSGISGPSASKRQLQRRGSWRQRVSXVSIHGYPFPLGFYLNCFFARASNKKNVVVGCIGSTGTPSTLTHFLGVSGWNHFFKIPLSI

SEQ ID NO: 89578 - DNA, 752 bp, Zea mays
  misc_feature: Ceres CLONE 1577297
  misc_feature: Encodes the peptide sequence at SEQ ID NO. 89579
tggagctccaccgcggtggcggccgctctagaactagtggatcccccgggctgcaggaattcgtctcacccctagaaaaaacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagaagtttgtgcgaatacttcctaccatgtgaaatcaatttgtaagctgggtgaatttttgggaaaaaaccccaatttccccccccccccggaaattcaaaaaaacctttgggcctgggggccccccggcttcccccctggaaagctttggccaaaacccaaaaagttttttcccccccaacacccctttttttttggggggaaatttttgaaaacaaaaaaaaaactctttttttttttgtggggccccccccaaaaaaaaacccccccccccaaaaaaaaaaaaacccccccccccccccccccaaaaaaaaaaaaatttttttttttaaaaagggggggggggggtggtgttttttcccccccccctctttttttttgtgtggggtggggggaggaaaaaaaaccccccccgggccgcgagaagaagaaaaaattttttttt

SEQ ID NO: 89579 - protein, 29 aa, Zea mays
  misc_feature: Ceres CLONE 1577297
MSAEVAGGHPYFLSCYFWFIYCIKFRDFT

SEQ ID NO: 89580 - DNA, 1313 bp, Zea mays
  misc_feature: Ceres CLONE 1577301
  misc_feature (46)..(46): n is a, c, t, g, unknown, or other
  misc_feature (47)..(47): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
acgggggggggctctcttgcacgcccctccccattaaaaaataatnntattnnnnnnnnnnnnntaatactggaactcaccgcggtggcggccgctctagaatagtggatcccccgggctgcaggaattcgtctcacccctagaaaaaacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggcgaatttggcaagactcaatttctctcatctgagttcagaaacccccccccagatctcctgctttccttaaagtcttgcccaccaaaattatctctcatcatctttctgtggacggggacagacacccgtttcggggcctgtcaggcttttggaatactccctttccaaaaaaattggtcctagaagggtgggaattgaccctggctcccctgagctgggaactgtcagccccgggtgaaaattctttttaccctggctgacatttcctgtggcccgcccccttatagaaaaaggcgggagcttcctgtcctgggccttctcggagctatggtatgaaattccccgtggtatccttcaagaggctgttctgcccttggaccctacggtgcgccaccagcaaaaagccttttcgctctagctatatcctcgtggggtggaaatacctctgagtctgcgagatcctccacccagaccgcgagaaggaactctatttctcacagccatttatgttatatccgcccgagagcaacataccacctgtgcccggtttgtgttctctttaaaagggacagataacacaacatgggctcccactttcgagggggtgatatgggggcggcgcaaaactcttattctcctggagcgcgctcctggagattgttccgatgcgtttccaccttccaaattctctatatgtttggaagctcactgattctctctcctttaccctcgtaccgcagggacgatactcttggttgataaaaaaacaacaacgcgtggaaagcgcaacaatcccaaacgcgctgaatttcgttacaagctttgcccctcccgggtagattgtatgtgtgaagcctcccctctccgaaaagacaaaactcttagaagtg

SEQ ID NO: 89581 - DNA, 857 bp, Zea mays
  misc_feature: Ceres CLONE 1577307
  misc_feature: Encodes the peptide sequence at SEQ ID NO. 89582
tggagctccccgcggtggcggccgctctagaactagtggatcccccgggctgcaggaattcgtctcacccctagaaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgtttatggtgaacccattgatgagaagggtgacataaagacaaaccacttcctccctattcatcgtgaagccccctgcttttgttgagcaggccactgagcagcaaaattcttgttactggaatcaaggtccgtggaatcttcttgcaccctaccaaaaggggttggaaaagattggtcctctttcggtgggtgcagggagtgga

SEQ ID NO: 89582 - protein, 196 aa, Zea mays
  misc_feature: Ceres CLONE 1577307
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVYGEPIDEKGDIKTNHFLPIHREAPCFC

SEQ ID NO: 89583 - DNA, 809 bp, Zea mays
  misc_feature: Ceres CLONE 1577309
  misc_feature: Encodes the peptide sequence at SEQ ID NO. 89584
ggagctccccgcggtggcggccgctctagaactagtggatcccccgggctgcaggaattcgtctcacccctagaaaaaaaaaggagaagccgccatgaagcagcagcagctgcagctgcctcctagtcgtcccagttaaatccgtgctcgccaagccacgactacgagcacctgccccggtttttctcctcccgcccccgttccccgtcccgactcccgaccgacccaacccatatcagagattccttccttggtggcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccacgcctcctccgagtacagcgccagcgccgtggccgacgactcgcccaggaagccgccacaggcgcccgccaccacggacgcccacgcgccgccgcccgccaccgccaccgccaccgccgccatgaggcgcggcggggccggcgcgccgccggacctggggtccgtgctcggccaccccacccccaacctccgcgacctctacgcgctcggcaaggaagctcgggggagggggcagttcggcacccactttcctctggaaccgagctcggccacggggggtcgaactacgccctggcaagttccatcctccaaagcgcaagcctcattcaccagggggaggaacggcggacggaacgtggggccggcggagaattcaa

SEQ ID NO: 89584 - protein, 151 aa, Zea mays
  misc_feature: Ceres CLONE 1577309
  misc_feature: SWISSPROT Homolog: EC 2.7.11.1 Non-specific serine/threonine protein kinase
MGNACGGALRSKYQHSFKHAASSQRHASSEYSASAVADDSPRKPPQAPATTDAHAPPPATATATAAMRRGGAGAPPDLGSVLGHPTPNLRDLYALGKEARGRGQFGTHFPLEPSSATGGRTTPWQVPSSKAQASFTRGRNGGRNVGPAENS

SEQ ID NO: 89585 - DNA, 846 bp, Zea mays
  misc_feature: Ceres CLONE 1577311
  misc_feature: Encodes the peptide sequence at SEQ ID NO. 89586
ctccccgcggtggcggccgctctagaactagtggatcccccgggctgcaggaattcgtctcacccctagaaaaaacacaaaaaacctcaccttctcattccttcaagcgtcagcagcaaaaccagagcttcccttcaacccagcaagaaaaccaagcgacctagttagcgcagcggcagttatttgtgcagaccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccatcacccggaggctccgcgcgcagggcgtgcgcgggccgccctacacgttctttcaccgggagcctcggcgagatcaagcggctccgcgccgagggcgccgccgtcacgctggacgtcgacgaccacgactttcatcccatggtgcagccccatctccgcaaatggatcgcgctctacggtacgtgcagtgcagcgtcgtcacagccgcttcttcacttcggcggcgctcgatcgcttttccatcttaatcttaactacgacagcgggcctgcattgctgcagggccgaagtttcttgtacgggaacgggcccgagggccaaaactgtggcggtggcgaaaactggaacctgggtccggggaaggggctcttttcacccggaacgggggtcttacccccaagaaaccttaattaaacccggaaaaattttccccccctgggttctgggaaaggggcctttttctccttaccgaaaggggggaacaaaaggggagaacgc

SEQ ID NO: 89586 - protein, 114 aa, Zea mays
  misc_feature: Ceres CLONE 1577311
MGLAWMVAAAVAAVLASWAFNALVHLVWRPYAITRRLRAQGVRGPPYTFFHREPRRDQAAPRRGRRRHAGRRRPRLSSHGAAPSPQMDRALRYVQCSVVTAASSLRRRSIAFPS

SEQ ID NO: 89587 - DNA, 1050 bp, Zea mays
  misc_feature: Ceres CLONE 1577313
  misc_feature: Encodes the peptide sequence at SEQ ID NO. 89588
ctccccgcggtggcggccgctctagaactagtggatcccccgggctgcaggaattcgtctcacccctagaaaaaaaaatggcagcgcagcagcacgagcagcacgccgtgccgctccaaccgtctcgcttccctgcttagcttcccgccgcgccatggagtcgaccaacgcacccggccctggcgagaagcaccactccatcgacgcgcagctccgtcagctggtcccaggcaaggtctccgaggacgacaagctcatcgagtacgatgagctgctcgtcgaccgcttcctcaacatcctccaggacctccacgggcccagccttcgctaatttgtccaggagtgctactaggtgtcggcctactatgagggttaatgagacacgacgaagctggcccacctcggtgccaagctcagggggatggaccccaccaacgccatccctcatgacgaagctccatcctgcacatgctcaaacctcgcaaaccctggccgaagaaggggcagatctgccccaccccccgccgctaaaagaaaaactctagaaaggggggggtttcccccaaagaagggcttcccgcccccacccgaatcccgaaaatcgaaagaaaaaaccccttagaggggcccccgggggtcccaaaaggggggggacaaaagtccccccgagaaaaaggtgggttacaaagaggcggctacaaaaaaacacagaaacgtggggaaagccttccttcttctaaaagcgggtttatcccccgtggtaggtctcttctccgggggtggtgtaattttgtggaaaaaaaacacccggcgaactgcgaaaaatttgttacgcgccccgcggagaagaaaaggaggagattcttttgacaaaaaaaaaaggggggccccctggggggctttcttaaaaaagagaaaaagcctcttttagaaaacaataaagagaggggggcgcgcccccccccccaaaaaaaaaattcgggtgagaagacaacccatcaaaattgttggaggagggggccctatactggccgcggtgagaaacacaag

SEQ ID NO: 89588 - protein, 58 aa, Zea mays
  misc_feature: Ceres CLONE 1577313
  misc_feature: SWISSPROT Homolog: EC 4.1.1.31 Phosphoenolpyruvate carboxylase
MESTNAPGPGEKHHSIDAQLRQLVPGKVSEDDKLIEYDELLVDRFLNILQDLHGPSLR

SEQ ID NO: 89589 - DNA, 813 bp, Zea mays
  misc_feature: Ceres CLONE 1577315
  misc_feature: Encodes the peptide sequence at SEQ ID NO. 89590
ggagctcaccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcacgcaccgccgccgctccgacatcgcccgccgccaggacggcctcctcgtcttcgtcttcttcctctcgattcccatacgtaccagtagttttaatttaagtagtattaattgtaataacaatctcttgtaaactgcgctcgcctttgcgtgttcctgctccttttgcgctttctcgtcgctctttgtctcagtctctccttattcgtctacttccacggcgaacccggctgctggtatggatcccaatggacgcaaaactggacgccttttgctcccgaccatcgagaggcggtgcacgtggcctccatccgtcattgtcatctgcggtggcatatcgggcgttgcagctgcccgtgccatctccaattcttcatgttatgcgactgctttggaatcgggacatcgatttggcgggcgcattcatacttgataactggtttggatgcccaattgattttgggagcctccatggctacacctccgtgttggaattgagaatccaactgggcaccatttgaataagctaatcttgggagctggagggttaatcccgccaagaggcaaatg

SEQ ID NO: 89590 - protein, 64 aa, Zea mays
  misc_feature: Ceres CLONE 1577315
  misc_feature: SWISSPROT Homolog: EC 1.4.3.2 L-amino-acid oxidase
MDPNGRKTGRLLLPTIERRCTWPPSVIVICGGISGVAAARAISNSSCYATALESGHRFGGRIHT

SEQ ID NO: 89591 - DNA, 838 bp, Zea mays
  misc_feature: Ceres CLONE 1577316
  misc_feature: Encodes the peptide sequence at SEQ ID NO. 89592
  misc_feature (608)..(608): n is a, c, t, g, unknown, or other
ctccccgcggtggcggccgctctagaactagtggatcccccgggctgcaggaattcgtctcacccctagaaaaaataccgccgaaccaaatccaacgtccgcagaaaccacactcccgtcgagggggaggcgtcgacttcccatagtttccactccacttcgatcctaatcctatcctccccaaacaatccaccaagaaccttttcccccctccaatagtccaagttactcggaggaatccatgtgcggaggtgcaatcatcttggactacatcccggcgcggcgccgggtgtccgccgccgacttctggcctgactccgaagccgacgccgaggactccgactcgcacgcccctgaccctgagagagccccgcgcccgcgcgggaaggcgaagcgtgggcgcaagaaccagtaccgcggcatccggcagcggccgtggggcaagtgggcggcagagatccgcgaccccgtgaagggcgtgcgcgtctggctcggcacctaccccaccgccgaggggcgcgcgcgcgcgtacgaccgcgctgccaggcgcatcaggggcgctaaagcaaggtcaacttcccaacgacgcccctctctcagaggtacgngccgaacgcggcatctggggtggcgggacagccccggccgtttttctcccggggccagggaaaggcgcccccacagtgttcgacaagttcaggaactgtccaagagctaatggctacaaaaactaatgaaatttctgggggtccctaaatgaaggggggaatcccccttaaatgcccccccccttgccggttgcccttgcccccttcccaaaaaaaccaggggccggggc

SEQ ID NO: 89592 - protein, 158 aa, Zea mays
  misc_feature: Ceres CLONE 1577316
  misc_feature (56)..(107): Pfam Name: AP2 Pfam Description: AP2 domain
  misc_feature (123)..(123): Xaa is any aa, unknown, or other
MCGGAIILDYIPARRRVSAADFWPDSEADAEDSDSHAPDPERAPRPRGKAKRGRKNQYRGIRQRPWGKWAAEIRDPVKGVRVWLGTYPTAEGRARAYDRAARRIRGAKARSTSQRRPSLRGTXRTRHLGWRDSPGRFSPGARERRPHSVRQVQELSKS

SEQ ID NO: 89593 - DNA, 863 bp, Zea mays
  misc_feature: Ceres CLONE 1577321
  misc_feature: Encodes the peptide sequence at SEQ ID NO. 89594
  misc_feature (717)..(717): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaactccactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgattaccaggactacaccccctgcaccgaccccaagcgctggcggaggtacggcaactaccgcctgagcttcatggagcggcactgcccgccgccgcccgaccggcagcagtgcctggtgccgccgcccaaggggtacaagccgcccatccggtggcccaagagcaaggaccagtgctggtaccggaacgtcccctacgactggatcaacagccagaagtccaaccagcactggctcgtcaaggagggcgaccgcttccggttccccggcggcngcacttcagtgcatgcacgcgcgtcactacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 89594 - protein, 196 aa, Zea mays
  misc_feature: Ceres CLONE 1577321
  misc_feature (186)..(186): Xaa is any aa, unknown, or other
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPKGYKPPIRWPKSKDQCWYRNVPYDWINSQKSNQHWLVKEGDRFRFPGGXTSVHARASLR

SEQ ID NO: 89595 - DNA, 774 bp, Zea mays
  misc_feature: Ceres CLONE 1577323
  misc_feature: Translation starting site: 242
  misc_feature: SWISSPROT Homolog: EC 1.3.3.9 Secologanin synthase
acccgcggtggcggccgctctagaactagtggatcccccgggctgcaggaattcgtctcacccctagaaaaaaccttcaagcgtcaagtagcaaaactacagctttccttcacccccagcaagaaaaccgagcgatctagcagactaccacagaagatttcctactcggccgcacgtgcagaccctgatctgactgagagaggcaggcagcagctcgatcggcagtaaccgtgagcgagccatgggactggcctggatggtgacggcggccgtcgcggcggtgctggcgtcgtgggcgttcaacgcgctggttcacctcgtctggcgtccctacgccatcacccggaggctccgcgcgcagggcgtgcgcgggccgccctacacgttcttcaccgggagcctcggcgagatcaagcggctccgcgccaagggcgccaccgtcacgctggacgtcgacgaccacgacttcatccccatggtgcagccccatctgcgcaaatggatcgcgctctacgggcggacgttcgtgtactggaccggcgcgaggccgaacgtgtgcgtggcggacgtgaacgtggtcaggcaggtgctcttcgaccgcaccggcctctacccaagtacctcatgaacccgcacatctcccgcctgctcggcaagggcctcgtcctcaccgacggcaacgactggtagcgcacccgcagggtcgtgcaccgggccttcaactggacaagctcaagctgatgacggcgaccatgtccgactgcgctcgctcga

SEQ ID NO: 89596 - DNA, 845 bp, Zea mays
  misc_feature: Ceres CLONE 1577324
  misc_feature: Encodes the peptide sequence at SEQ ID NO. 89597
  misc_feature (839)..(839): n is a, c, t, g, unknown, or other
ggagctcaccgcggtggcggccgctctacaagtcctggatcctccgggctgcacgaattgttctcacccctagaagaattccgtcccatcacggacgtcattgctctatacaggacagctccctctagaaagaaatagagaggttcttggcatattggagaacgcaatcactgctgtgcaaaaagacaaaatgaccatagcttcccaatttgaaagaactaccacccacataacttctgggaaagaaaagtttattcgattatatgccgacctgcagaatttccggatacagactgaaaaggaccgtgcaaagttaacatctaatatacggatggaagttgttcagactctgttacctctagttgatagttttgagaaaataaatctagagaacaccccacacactcagaaggagcaaaagatctgcgcaagctatcaaggcatatacaagcagttagttgaaacactaagatatttgggtgtgggagttgtggaaacacttggcaagccatttgatccttcggtccatgaggccatctcacagagaagcatccatgcaattcaaggcagggattgtcatgcatgaagtccgcagagggttccattctgaggagaaggtgctaaagcctgctactgtgaaggtctctaccgggctctggcaaacaaaagtgcaagactccataatgccgagggacaaaaaatgctggcctttgtagaatcctgaatccaaaacaccccaactggggacctggaaagcaccacttgttttggcggagtgcattaaccaggccccgaaactggtgtcttcgcatccccccgaagtgcggagaacggcccanttcccc

SEQ ID NO: 89597 - protein, 131 aa, Zea mays
  misc_feature: Ceres CLONE 1577324
  misc_feature (4)..(125): Pfam Name: GrpE Pfam Description: GrpE
MTIASQFERTTTHITSGKEKFIRLYADLQNFRIQTEKDRAKLTSNIRMEVVQTLLPLVDSFEKINLENTPHTQKEQKICASYQGIYKQLVETLRYLGVGVVETLGKPFDPSVHEAISQRSIHAIQGRDCHA

SEQ ID NO: 89598 - DNA, 990 bp, Zea mays
  misc_feature: Ceres CLONE 1577325
  misc_feature: Translation starting site: 179
  misc_feature: SWISSPROT Homolog: EC 3.4.21.10 Acrosin
aagctggagctccccgcggtggcggccgctctagaactagtggatcccccgggctgcaggaattcgtctcacccctagaaaaagccaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccactgccacggcaagacggccaatgtgatgcacctgctgctctggggacccaagtgaagcggcgacacgccaccgtaccgcctgtctctcccgctggcgttgctcgttttgctctgcctgcaatccgccccgcacggactgtactggacccatttattcacctacctactacggacgtgcaccctgtactccgacctggcctgcggtaccataactaaataccaagggcgctgccggccccccttggctttaaaaaaaagggacggggagccccaagaaccccccaccggggcacccggccccccgcccggaaaaaaaaccgacccaaaaaccctaccttgtaagggcggggccccccccaccggtggcctggtgtttccctccccgggggtggggcccccctggatccccgcttgtgggaaacgtggccaaacccccttgggggcccggcgcgtgtgccacaggcccccctaaaacccttttgcgttccccccgggtggggcaaaaaaggggggttttcgtgtggtttctccccccccccggtggcgggggtgggggctcctcccgtgtaaatctcctaaaatggccccgggacccccctatataaaatgtttatcccgggggggggccccgctccccccctgtgaggtgggggg

SEQ ID NO: 89599 - DNA, 1180 bp, Zea mays
  misc_feature: Ceres CLONE 1577326
  misc_feature: Encodes the peptide sequence at SEQ ID NO. 89600
  misc_feature (13)..(13): n is a, c, t, g, unknown, or other
  misc_feature (16)..(16): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (899)..(899): n is a, c, t, g, unknown, or other
  misc_feature (933)..(933): n is a, c, t, g, unknown, or other
tttttttttgttnatnttagattactatcactatcttacctctatacatttcgcgtcggttattaaggggtnnnnnnncccaannnnnnaaaaatggggctcaccacggtggcggccgctctagaataatgggaaccccggggctgcgggaatcgtttcacccctagaaaaaccagcggcatctatagcaaccggtccagcactttcacgctcagctccagcaatggctgcctccaccatggccgatctcctccacggcgatggccggcacccccatcaaggtgggctccttcggggagggccgcatcaccttgcaaaaaaacgggggaaaaccccgggggggggttttccgggcaccccttggacccccccccaaccggataaaatccttccccccccttgcgggggggaaccccctgatttttttttcgggggaaattttcccgggaaaaaattattggcggggaaaccccggggggggtgttttccccccaaccccaaaaattttttttaaaaaaaaaaaacccggggggggtggggggggttttccccttcccccggagggggcgccctttttttgcggggccgcttgtggtgtcttttggttttcatccacggaaaatatattactttcctcctacaacaaaagtattttttaatattatttgtggggtaggaagagcaccccctcttatgggggtagtgaagagagagccatctttctcttaaagaagttagatggagttataaaggactatcgatgggcggccgtttttttatattgaaggaggagatacttctcctccattggaatagccaccttcgttgtgagtagtgtttgtttaattcggtatgatgggtgagggaaagtaaacattacttctctcgcgcgctctccnctctagtttattgagttgcgtttgcaatgaactngatagagtctttaatttgagtgagatgacgctaagatgtgtggtcgtgctcgtcatccttcgataagaaagtatgcaatgagcaaatcgggtctgttagtggtgaaagcggatgaggtgggcgttgtacatgttatattcgactctttttccttatgtaagagtgatgtctaggaagaatatgattatgtcgtcgcgggtgacagatggttctgttctctaatttcatgcggggatggtaacgtgtc

SEQ ID NO: 89600 - protein, 132 aa, Zea mays
  misc_feature: Ceres CLONE 1577326
MAGTPIKVGSFGEGRITLQKNGGKPRGGVFRAPLGPPPNRIKSFPPLAGGNPLIFFSGEIFPGKNYWRGNPGGGVFPPTPKIFFKKKKPGGGGGGFPLPPEGAPFFCGAACGVFWFSSTENILLSSYNKSIF

SEQ ID NO: 89601 - DNA, 846 bp, Zea mays
  misc_feature: Ceres CLONE 1577329
  misc_feature: SWISSPROT Homolog: EC 2.7.2.3 Phosphoglycerate kinase
ctccccgcggtggcggccgctctagaactagtggatcccccgggctgcaggaattcgtctcacccctagaaaaaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggccggccggtccgcctcacggcgagaaccgaccggctcgacccttctgccggcgatgcgctcctggccttaactggccgggtcgtgcctccggcgccgttactttgaaaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgacctcgaggggaaagcgcgtcttcgtgcgcgccgacctcaacgtgccgctcgacgagaaccagaacatcaccgacgacacccgcatccggggccgcatccccacccatcagtacatcctcagcaagggcgccaaggtcatcctctcaagccactttggtcggccctagggttt

SEQ ID NO: 89602 - DNA, 750 bp, Zea mays
  misc_feature: Ceres CLONE 1577331
  misc_feature (498)..(498): n is a, c, t, g, unknown, or other
  misc_feature (499)..(499): n is a, c, t, g, unknown, or other
ctcaccgcggtggcggccgctctagaactagtggatcccccgggctgcaggaattcgtctcacccctagaaaaatcccatcctccgatttcccttcccacgccgtccccccaccccccagatcggcaaatccgcccgcacctgctctgcgcgcgtcgcgcgtcccggatggccatcgtctcctccgcccgactcgtggttccgtagcatgggccactccccctcttccctttccaaatccggcccctcctctccaccgcgccgcagcaggtcattctcccccatggcgccgccgcagcagctgctgctgaccgcgccgttgcaggtcgctgcggggggcagcggcagcgactcgtcctcctcgttcgcgccccccgctcgggactacacccaggacctgcccgacgagatcctcgcgctggtattcgcgtcgctctcgcccaccgaccgcaacgcctgctccctcatctgctcccgatggatgggaggtcgacgccanncacgcgcaccgggtctccctcgacgcccgcgccgcgctgggggacgcggccaccgcgctgttctcgcgggttccggctgtcacgaagctcgggctccgctgcgcggcggactcaagatcggaaagcctcttcgaacacggggcttgcggggcttggcgcccccgcttccctcgggagggcctaagcaaggctccaaactccgggggtctaagggagtttttcgaaccccgggggttaacccccccttgctt

SEQ ID NO: 89603 - DNA, 832 bp, Zea mays
  misc_feature: Ceres CLONE 1577332
  misc_feature: Encodes the peptide sequence at SEQ ID NO. 89604
  misc_feature (725)..(725): n is a, c, t, g, unknown, or other
ccccgcggtggcggccgctctagaactagtggatcccccgggctgcaggaattcgtctcacccctagaaaaaacgcgtccctcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccaggtactattgacccccgccccctcctcctctgtctctgaggtttttacatgactactctaagacattcaccctctcttgaggtagaagggtcaacaaggaccattgtcagtcacaatgaacatgtggcacacatctttctttctggtaacttattttagcatgacctataaaccgggcataatttgatgctttatttagggtgtgtttggttgaggagcggaaggaaatggaacgactctattcttattttttttatatttggttaccatggaggagagcggagcgggctcctgaagtctataaacaacaaatatttgggatgctctcgctccanccaaaatgaccggatacgagcgctctcattcctctcctcaactcaacagtcatatgggctcttcaaccaaaaaaataaacggagcggctccgcctctaatctactct

SEQ ID NO: 89604 - protein, 87 aa, Zea mays
  misc_feature: Ceres CLONE 1577332
  misc_feature (46)..(70): Pfam Name: zf-LSD1 Pfam Description: LSD1 zinc finger
  misc_feature (7)..(31): Pfam Name: zf-LSD1 Pfam Description: LSD1 zinc finger
MQNQIMCHACRTLLLYPRGASSVCCAVCQAITTVPPPGLEMAQLICGGCRTLLMYTRSADTVRCSCCNTVNLVRPGTIDPRPLLLCL

SEQ ID NO: 89605 - DNA, 881 bp, Zea mays
  misc_feature: Ceres CLONE 1577334
  misc_feature: Translation starting site: 101
  misc_feature (498)..(498): n is a, c, t, g, unknown, or other
ctccccgcggtggcggccgctctagaactagtggatcccccgggctgcaggaattcgtctcacccctagaaaaaagcgcgcgaggcgaggagaataagctatgggcgcgccgaagcagaaatggacgtcggaagaggaggatgcgctccgcgccggcgtgcgcaagcacggcgccggcaaatggcggaccatccagaaggaccccgagttcagcccggtcctctcctcccgctccaacatcgacctcaaggacaaatggaggaatttaagtttcagtgcaagtggactgggatcaagtaaactgcgggttccaaagataactggaccctcatcttccccatcatctagctcgcagcctctgcttctcccagcggcaaacaaatttactgaagctacactgcctgcagatgctgagaaaaagcacaggatgggaaaactctgccaaagtatggtgccatgatcatggaagctcttttggaattgaatgagccgaatggntcagatattgctgcaatcttcggcttcatagagcaaaggtatgcggtacaacggaccttcagaagatttctaggcttcaaggttacggcgacttgcagactcaaaccaaaattgaaaagatcgataagtccctataggatcccagaatcccttggaaaaaggactcagggctcccatggaagctccggttccaaaacaaaggggtcctcaaagcccttcaaggggtcaaaagcccatgggaatggttttttgcccccccccccgaccaaaggggttcaaaagggaccctctttaaaagggggcttaacccgggggaaaaaccctttggtcccctttaccccaaaggggggcggaaagggctccccgaggggggggggagaact

SEQ ID NO: 89606 - DNA, 1038 bp, Zea mays
  misc_feature: Ceres CLONE 1577335
  misc_feature (402)..(402): n is a, c, t, g, unknown, or other
ctggagctccccgcggtggcggccgctctagaactagtggatcccccgggctgcaggaattcgtctcacccctagaaaaaaacctctaaacggcgttctaataaatcttcctcgcatctctctcgctccgaatcgtgaagtccccaccaacgcaaacctggtggcaccggccgcacacactaaagcaagctggctagtcactattagagctatttaggtggaagcagtttaactcagcaagatcgagctggcattatcacacacatctcagctgcttaggttttccatcttgatgaggagaattccagctcgacgtcttgcataatgcacatgcagttacagatacatccgtctacgcggagattgattttttgggcgagaaaggagaacgagcccaccccncaacaagtaaaatgcgtacgtcctctattgagatatactcatactaagattctgggacggccggcggccgatgcataatgagcatggccatgttggcgacgcttgaccccaaagaaggtgctccctgggcgatgcttgaccccggacgatgatggatgagcaccgaggcagacaacaaagactgaccggaagggaccttcctgtttgctaaaaaaggattcgggaacaccgggaatgatggactgaccggacccttgtaacggcataattcattcctaacccgaaaccatccttgcaaagggtctggggatggaaatacaacagttccctatccaaaaagtgggatctgtgaacccccggggcctccggcaaagaaaaaagtatccgggccccccaagaatttgttcatgggaaagggagagactccttccggagccgacaaacacggatgggatggaaagaaattggccaaatactctgaacctcgtgtctctcaaaagagaattttcccggtggggcgggcctctcgtggcgtaaggaaatctcccccacctataaaaaaaatccgggtgggcaatggtcccctttatggcaaagacgtttcattattgccggtgtttgtgacgctttcttaaa

SEQ ID NO: 89607 - DNA, 791 bp, Zea mays
  misc_feature: Ceres CLONE 1577337
  misc_feature: Encodes the peptide sequence at SEQ ID NO. 89608
ctcaccgcggtggcggccgctctagaactagtggatcccccgggctgcaggaattcgtctcacccctagaaaaaatcccatcctccgatttcccttcccacgccgtccccccaccccccagatcggcaaatccgcccgcacctgctctgcgcgcgtcgcgcgtcccggatggccatcgtctcctccgcccgactcgtggttccgtagcatgggccactccccctcttccctttccaaatccggcccctcctctgcaccgcgccgcagcaggtcattctcccccatggcgccaccgcatcagctgctgctgaccgcgccgttgcaggtcgctgcggggggcagcggcagcgactcgtcctcctcgttcgcgccccccgctcgggactacacccaggacctgcccgacgagatcctctcgctggtattcgcatcactctcgcccaccgaccgcaacgcctgctccctcatctgctcccgatggatggaggtcgacgccaccactcgccaccggctctccctcgacgcccgcgccgcgctggggaacgcgggcaccgcgctgttctcgcggttcacggctgttacaaatgctcgcggctccgctgcgcgcacgaatcaaggatcggaaaaacctctgccaaccacaggggtttcgggggctgggcggcccgcgctttccccttggaaaaccccctaaccaagggcttcaaggcttccacggggtcttaaaggcgaggctttctccaaaccgccgggggcaaaatccctcacacttctgctgtgccgcgggctcc

SEQ ID NO: 89608 - protein, 136 aa, Zea mays
  misc_feature: Ceres CLONE 1577337
  misc_feature (34)..(80): Pfam Name: F-box Pfam Description: F-box domain
MAPPHQLLLTAPLQVAAGGSGSDSSSSFAPPARDYTQDLPDEILSLVFASLSPTDRNACSLICSRWMEVDATTRHRLSLDARAALGNAGTALFSRFTAVTNARGSAARTNQGSEKPLPTTGVSGAGRPALSPWKTP

SEQ ID NO: 89609 - DNA, 968 bp, Zea mays
  misc_feature: Ceres CLONE 1577339
  misc_feature: Encodes the peptide sequence at SEQ ID NO. 89610
  misc_feature (784)..(784): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
ggagctccccgcggtggcggccgctctagaactagtggatcccccgggctgcaggaattcgtctcacccctagaaaaaaccgctctttcccgttcatccatcacaccatccccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaacaaagncataatgggcatcacagactactcgcagaactatgacgtgatagtagcggggnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnn

SEQ ID NO: 89610 - protein, 121 aa, Zea mays
  misc_feature: Ceres CLONE 1577339
  misc_feature: SWISSPROT Homolog: EC 2.1.1.103 Phosphoethanolamine N-methyltransferase
  misc_feature (104)..(104): Xaa is any aa, unknown, or other
MDTVGVPVVAVANGIGEVERKVQKSYWEEHSKCLTVESMMLDSRAADLDKEERPEILSLLPSYKGKSVLELGAGIGRFTGDLAKEAGHVLALDFIESVIKKNKXIMGITDYSQNYDVIVAG

SEQ ID NO: 89611 - DNA, 841 bp, Zea mays
  misc_feature: Ceres CLONE 1577343
  misc_feature: Encodes the peptide sequence at SEQ ID NO. 89612
  misc_feature (774)..(774): n is a, c, t, g, unknown, or other
ggagctccccgcggtggcggccgctctagaactagtggatcccccgggctgcaggaattcgtctcacccctagaaaaattcctcgcccccttcccttctcgaggattcgcgtaatcgtcaccatgcgccgcccgtggaggcactcgggcccagggtccgccgtcgcggcgcgccacggcgccgcggacctctgcctccgcgaggtcggggacctcctgccgcgacgcttcgcccgccgcgcggccggttccgaggaccttgtaatgcggctccagattcaccggaagcttgacaggcacacgggctgcgtcaacacagtgggcttcaatgaggtcggtgacaccctcatatcggggtctgatgatcagaaggtgatgctgtgggactgggacactggcaccgtcaaattagagtttcattcaggacatggcggcaatgtgttccaggcacggttcatgccctgctcagacgatcggaccattgtcacttgtgctgctgatggcgaggtgaggcttgccaagatacaggatgctggagacgtgtccacaacattgcttggtgaacatgagggaagggctcacaatttggctatagagcctggtagtccttacattttctacagctgtgtttgatctcagaacaaacacagcctcaaaactatttctttgcagaaactccactaaatcagtatactcatctcttgttcacctaaatgcgcttgcaatagatccggaggaaccccaatctttttgttggttggaggaagcgatgccntatgctcgtgtggtatgacattcccaaggtgcaaggggggatggatcatccggattttagtccccgc

SEQ ID NO: 89612 - protein, 169 aa, Zea mays
  misc_feature: Ceres CLONE 1577343
  misc_feature (50)..(88): Pfam Name: WD40 Pfam Description: WD domain, G-beta repeat
MRRPWRHSGPGSAVAARHGAADLCLREVGDLLPRRFARRAAGSEDLVMRLQIHRKLDRHTGCVNTVGFNEVGDTLISGSDDQKVMLWDWDTGTVKLEFHSGHGGNVFQARFMPCSDDRTIVTCAADGEVRLAKIQDAGDVSTTLLGEHEGRAHNLAIEPGSPYIFYSCV

SEQ ID NO: 89613 - DNA, 788 bp, Zea mays
  misc_feature: Ceres CLONE 1577345
  misc_feature: Encodes the peptide sequence at SEQ ID NO. 89614
ccccgcggtggcggccgctctagaactagtggatcccccgggctgcaggaattcgtctcacccctagaaaaagagccgagagggggaaggtggagagagaaaaaaagcggtggcgcgaacgggagggaagcctggctatcctatccccgcaccgtcgcacgcacacatcacccaccccgtcgcagtcgcacctgcactgcatcctgcgcctgcccgatacccaattattctccctctctatggatcaccaccgcacgccgatggagaactcggcgtcctcgaagccgccaacgccggcgtccacgcccaactcgcgcctcgcatcggcgccgtcaccccgccacgccgccacgccgccgcacgcgtacgcgccggcgtccgccccggcgccggcctcgcgcaccgtctacagcgaccgcttcatccccagccgcgccggatccaacctcgcgctcttcgacctcggcccctcgccctcgcccgccgacgccgccgcctcctcgtcctcctcccacgaggccagccccgcggcctcgtccggatctgcgcccgccgcggcgtcgccctactgagcgctcctccgcgccgcgctcttcgggcccgacacgcccgaccgggtcgcgtcctcggacgccgcgtgctcgtcctcctactcctcctccccggggtctctcgcctgatgggcacccccgccaccggggaacatcttcagattcaagaccgaaggtgcgccgggaacgccaagagggcgcctttttttcccgaaggggagggacggagggaagaaa

SEQ ID NO: 89614 - protein, 110 aa, Zea mays
  misc_feature: Ceres CLONE 1577345
MDHHRTPMENSASSKPPTPASTPNSRLASAPSPRHAATPPHAYAPASAPAPASRTVYSDRFIPSRAGSNLALFDLGPSPSPADAAASSSSSHEASPAASSGSAPAAASPY

SEQ ID NO: 89615 - DNA, 802 bp, Zea mays
  misc_feature: Ceres CLONE 1577348
  misc_feature: Encodes the peptide sequence at SEQ ID NO. 89616
cggccgctctagaactagtggatcccccgggctgcaggatttcgtctcacccctagaaaaaacaccttgtgtcgtaccctccggatcgaaggctggacgacgcgaccgcgcggcggcggctcgacgcgaccggtggctttgacgcgaccggcacggcggcgacgctcaggccgacgacgaccctccccggtgccttctccccgggcatttgctggagctggaaggcggaagcgttcccgctggatcacttcgcgggctggaaagagcgaaagacccggatgcactaaagcccgtcttggaacagttacggccctggaattgatcccatgctgccgaacgggccctaagttggaacctgttcaggcggggggtcagctcgcagctgactggggatccggcaccgcatcgacagacgccaggaggggactatcagccatggcagcgaggaagacgcccccttcgtcctcggtcgcgcccgcgcccgcggcgggtcgctccatgatggactacctcaagaggtacttgtgcggccccagggaccgacggctaccccgaagagggccgagaagaccaacgaagaggaggcccaaggccgccggcgggggggctcatcggcggaccaagaacccgtggtggcagaaaccccctcccggggggacaagaagccccggcgccgccaggggaaccacaagccctctggggtcgacaaagaaaatcgaaggcccaaccgggatgccctccccccgtgaggggcagtacgcggccccccaagggccccttacaaaggcttacccccccaaaa

SEQ ID NO: 89616 - protein, 122 aa, Zea mays
  misc_feature: Ceres CLONE 1577348
MAARKTPPSSSVAPAPAAGRSMMDYLKRYLCGPRDRRLPRRGPRRPTKRRPKAAGGGAHRRTKNPWWQKPPPGGTRSPGAARGTTSPLGSTKKIEGPTGMPSPREGQYAAPQGPLTKAYPPK

SEQ ID NO: 89617 - DNA, 808 bp, Zea mays
  misc_feature: Ceres CLONE 1577354
aaagctggagctccccgcggtggcggccgctctagaactagtggatcccccgggctgcaggaattcgtctcacccctagaaaaaatttcccatggctcatcacgattttccgacgacccgtgtaaggccccaaacactcttcttctcctacctacacgttatcaggctccccttttaccatagagaccgagacgaagtacttcgagggcggacaactttttgccctgttcaagacgaattttgttataatctgcttcccgcccgacaccttcttcaacgtcgcccactccctgaagtgtctcctcacctacgtcgtctccctcctgattatcctcgtggataactgcctctatctcatctccacaagtatccccctgctctctctatgcatgctcctgctcgccctgtgctcctactcctgctacttcgtcttctagctcctctggctctcgggctgtccctatgctttcgaggcctgcgccaagtactgctacggtatcgacatcactgtgatcgcacgcagactgctctcgctccggagcatcgagaggcacctcacgttgtctgcagccgtcataatggtcaaccgtcgcgtctagctcgatgcattcgtccgctgcctgctcctgtgctgcttggaggacactgctttcgtactccaatatcagattcaccaggcgcctctctacgatgacttgggtctcagctccctctgcatcggagccttggtccctctcggcgtcagcacggacacccccctgacaccattgtcaggcttccctgggctggaggtatacttccccgaggt

SEQ ID NO: 89618 - DNA, 770 bp, Zea mays
  misc_feature: Ceres CLONE 1577355
  misc_feature (447)..(447): n is a, c, t, g, unknown, or other
  misc_feature (613)..(613): n is a, c, t, g, unknown, or other
  misc_feature (621)..(621): n is a, c, t, g, unknown, or other
  misc_feature (629)..(629): n is a, c, t, g, unknown, or other
ctccccgcggtggcggccgctctagaactagtggatcccccgggctgcaggaattcgtctcacccctagaaaaatcatcacacagcgccaccgcgtggttcgttaggaaaggaaatcgattcccctgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaaactgncggccgaagggagaaccccccccccgaaaaaattccttggggggggggggccccccccccccccttgtgtgggggggggggggagaagaaaaaaaaaaccccccccgcgcgggggggggagattttttttttgtttgtttttgtaaagaaagcgaggccgcgcaanaaaaaganccacccgncgccccccccacgggccggggagggagggagggtgtcttgttttttctttctcttgggtgcgggggccggggcgcggggggggaggggggaggaggtgagaaaagtggatgagagtgtagatgctggcgcctcctcttctg

SEQ ID NO: 89619 - DNA, 824 bp, Zea mays
  misc_feature: Ceres CLONE 1577356
  misc_feature: Encodes the peptide sequence at SEQ ID NO. 89620
tggagctccccgcggtggcggccgctctagaactagtggatcccccgggctgcaggaattcgtctcacccctagaaaaattcttcagccgcacgcttcttgttgccaaataattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgccgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttggactcctccctcctccatctccagcattgtgttttgattcacctgctccaatggcttgttctttctgctgctgatgcctccccgggctcaactatcgggttttgagggctatgaataagccccttgagatcacgttcctccggaggcaacctggtctttggtggaaccctcatggggtgtgggttttgcactgccccttctttcaaggggt

SEQ ID NO: 89620 - protein, 50 aa, Zea mays; identical to SEQ ID NO: 64299
  misc_feature: Ceres CLONE 1577356
  misc_feature (1)..(50): Pfam Name: AdoMetDC_leader Pfam Description: S-adenosyl-l-methionine decarboxylase leader peptide

SEQ ID NO: 89621 - DNA, 821 bp, Zea mays
  misc_feature: Ceres CLONE 1577357
  misc_feature: Encodes the peptide sequence at SEQ ID NO. 89622
ctccccgcggtggcggccgctctagaactagtggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcggggcgctcggcgaggtcgtcgacccgctgtaccctggcggcagcttcgaaccccctcgcctggccgacgaccccgaggccttcgccgagctcaaggtgaaggagctcaggaacggccggcctccccatgttttccatgttcgggtttcttcctcccgggcaatcgtacacgg

SEQ ID NO: 89622 - protein, 232 aa, Zea mays
  misc_feature: Ceres CLONE 1577357
  misc_feature (61)..(220): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGALGEVVDPLYPGGSFEPPRLADDPEAFAELKVKELRNGRPPHVFHVRVSSSRAIVH

SEQ ID NO: 89623 - DNA, 777 bp, Zea mays
  misc_feature: Ceres CLONE 1577358
  misc_feature: Encodes the peptide sequence at SEQ ID NO. 89624
ggagctccccgcggtggcggccgctctataatagtggatgccccgggctgcaggaattcgtctcacccctagaaaaaaaccctcttcgttgatcggagtggctagagctccccctgcacggctgtgcttctcctcgatttggcaagctcctggttacaggggcatctatcgttccgccacatcgtgtctctcatcacgctgcgcccgaccttcaagataatggctggccaccgaaacactcatggaaagcgcccgtctgattttactgaaaatggaggcggtaagagaacaaatcctgggaatgatacatatgacacctggtcccgatgacactgagtatctctacctctgcgcctctaagagaaatattgggagaatcattggcacgtgcggagaaattgcagagcaattgaagactaataccctcgctaagatcaagattggccgagagtgtccctagatgttacgagcgagttattaccatatttagcacaagcacgaaaactaataccatcgatggtgctgaacatgaagttcgccctgctcacgatgccctctttagaaatcactgacatgcttgccagtgatgagggtcttgggaacgtagacagcgaagacatttcacctcaagtcactgctcgcttgcttgtgccatcagatcacattggatgcatgatcggaaaacgcgggcagatcattcgaggaatccacagtgagactggtgcactaatacgtgtccatagtactgatcatatccccgcatgtgccggtagaggg

SEQ ID NO: 89624 - protein, 87 aa, Zea mays
  misc_feature: Ceres CLONE 1577358
MVLNMKFALLTMPSLEITDMLASDEGLGNVDSEDISPQVTARLLVPSDHIGCMIGKRGQIIRGIHSETGALIRVHSTDHIPACAGRG

SEQ ID NO: 89625 - DNA, 862 bp, Zea mays
  misc_feature: Ceres CLONE 1577360
  misc_feature (763)..(763): n is a, c, t, g, unknown, or other
  misc_feature (830)..(830): n is a, c, t, g, unknown, or other
ctggagctccccgcggtggcggccgctctagaactagtggatcccccgggctgcaggaattcgtctcacccctagaaaaaacggtgcccaccggcgtgggtgctggaccagcccctatgccctccaaacactatgcagagctcctgtaccctgtgcggccttgccggatctgatcaccacctacgtccctcccttccctgaactgtccctcgtcgcgggggccctcaacgtcaaacactctgggaatgctgaacccgccaccatcgccgattgacggcgaccgcgtacacgtcttcatctgcctctgagggcagcagcattcacgacctctttactccaccgaaatgccagcggaaaggccatggcctctccatccaaacgtgtgggcacgagctctatcaacactagggcctccgcacagacgtggactgctgcgaagaaactgtcaactgatttctctcactcgagccgagcaacgagacactgtgcttcagacactctggctcctacgactctgaagaactgcgtgcaactaagtaccgccgcgttatgaaagtcaccagccaagccattcgctacccatccactagcgatgctgcactttcactcagcgcgggtatcccatgtgcgaggcagaatgtcgtgttatcgctccacagattatgctacgcctggagaagatacatgattgtgcgagataaccaagtgtccgcacacgtgaccatctcatgcgtgctgcatgacgtccttcgcacttgaacgntgaatgctcaagtgcactcgaatcggagcatggtgcgcaagcgaacagttcctttgggctgcgcacntgatcattacccactacgaacgcgcacgtgac

SEQ ID NO: 89626 - DNA, 860 bp, Zea mays
  misc_feature: Ceres CLONE 1577361
  misc_feature (389)..(389): n is a, c, t, g, unknown, or other
  misc_feature (391)..(391): n is a, c, t, g, unknown, or other
ctggagctccccgcggtggcggccgctctagaactagtggatcccccgggctgcaggaattcgtctcacccctagaaaaaatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacggatgcctgctcgtcagaagtgaaggatttccgccctgaaacagctcgggctcccctgacgctgcccccccagacccctgctccccggcgcgctgccgccgacctcccttctccgcggtgctcgcccacgacggcgcgcgcatcncntccctcgccggggcgcctcgccaagaaggcgtccctctcgggcccaccttgcctttgaccaaaagcccccgcgggggggtcgcccttccgccgttcccccccgaatggaacaaagagcccccctcccgtttccgttggccccgcttccggggcccccggggggcaaccgtttcccgttttgcggggttttggtgggaaaaaacttacggtgtaacccccccgcaagtgggggggcccttcgggggcaaccgccccggggggcaaaaattccggtaaccgttcctgtggggcggcggggggaaacaccgggggggtccccccccgccccaccccccgggggtctccccaggggggtcccccccccgggcttcttgggggggggggggcccccccccccgttttcggggcccccgggggtttctaaaccccccagggggggtcgaaagatctctcttagaccctcccgggc

SEQ ID NO: 89627 - DNA, 813 bp, Zea mays
  misc_feature: Ceres CLONE 1577363
  misc_feature: Encodes the peptide sequence at SEQ ID NO. 89628
ctccccgcggtggcggccgctctagaactagtggatcccccgggctgcaggaattcgtctcacccctagaaaaaaaaaacccttccgccccgagccgaccggaaccctacccatcctgcagcgccgccgcccgcccgccccgccccttcagtccttcaccccctaccccttcaccccctaccccttcttgcgccgtcatcccgatcccctacgctcgctgaggcattatgggtaaatcaagcaagaagtccagtgttaaggctgcacctgctgctgtctcagttccagaggggaaatctgcaaagaaggggaagagaaatgcagaagatgagattgagaaggccgtgagtgcaaagaagcaaaagaccgtacctgaaaaagctgtgccggttaagaagcagccccctccaaagaaagttgagagcagcagctctgaggaggattcttcagattccgaagtggaggttaaggtccagccgaagaaggttattcaaccgaagaaaagtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagcagctctgatgaggaaccagcaaagaagcccacgggtcctttcaaagaagcccactgtcctttcaaagaagccccactgtctttcagaataacctgtcacagcagtcagtaatggttcaaaaacaggtaaacctgatagcagcagctctgacagtagctca

SEQ ID NO: 89628 - protein, 178 aa, Zea mays
  misc_feature: Ceres CLONE 1577363
MGKSSKKSSVKAAPAAVSVPEGKSAKKGKRNAEDEIEKAVSAKKQKTVPEKAVPVKKQPPPKKVESSSSEEDSSDSEVEVKVQPKKVIQPKKSTQPAKQESSDDSSSESSSDDEPSKKPVAGSKKPPASSSSSDDSSDSDDSSSDEEPAKKPTGPFKEAHCPFKEAPLSFRITCHSSQ

SEQ ID NO: 89629 - DNA, 806 bp, Zea mays
  misc_feature: Ceres CLONE 1577365
  misc_feature: Encodes the peptide sequence at SEQ ID NO. 89630
ctccccgcggtggcggccgctctagaactagtggatcccccgggctgcaggaattcgtctcacccctagaaaaaggcccggacgaccggagggagatacgtgtgcgaccctggacgtgcgagaagatccatccctccacacggatcccctcctgtccaccaggctacttaactgatgagacggcacggccaaaagattctcgtggacgtctccggcgcccaattgtatagtagcccgcgcgctctagcgagaagctagcgcgccatcgctgccggcgtcgtgtcatggaaatggtagagtgctccctcgttgctacacttgctccgcgcccgctgcccggacaggttcggaaggccttgccccggccggcggcttttggggcgagagcgagactccgcgtgcggtccgtgggccgagaggagcctctgcatccgcagcagacggcagtccgggcttccgggtcggatcacggaagccgggcgctggggcaggctgcggtggggttcgccgccgctgccgttgtgtcactaaccgggttctccggagatgtgtccccgctgccgacgccgcctgcccgggccgagtcgctcaccgtcgcgttccccgtctccaaggcgcgcgaagtgaacagagtgcagaggacgctggtggagacgtggggtctgatccgtgagacctttgttgatcccaccttctaccaccagattgggatcagaaactacagcaaaccatggtagagatatttccactggaatcagcggatgcccgctacagtaagatttagtgggatgctgtccacacctcgg

SEQ ID NO: 89630 - protein, 150 aa, Zea mays
  misc_feature: Ceres CLONE 1577365
MEMVECSLVATLAPRPLPGQVRKALPRPAAFGARARLRVRSVGREEPLHPQQTAVRASGSDHGSRALGQAAVGFAAAAVVSLTGFSGDVSPLPTPPARAESLTVAFPVSKAREVNRVQRTLVETWGLIRETFVDPTFYHQIGIRNYSKPW

SEQ ID NO: 89631 - DNA, 679 bp, Zea mays
  misc_feature: Ceres CLONE 1577367
  misc_feature (201)..(201): n is a, c, t, g, unknown, or other
  misc_feature (219)..(219): n is a, c, t, g, unknown, or other
  misc_feature (220)..(220): n is a, c, t, g, unknown, or other
tggagctcaccgcggtggcggccgctctagaactagtggatcccccgggctgcaggaattcgtctcacccctagaaaaactctctcgaaaccctagtcctctgttacttctcccgccgccgccaatcccctcccgttctccgccaccgccaatcccctcccgtcctccgccacctctgctgagagcgagaagagatggccnggcaagggtgatgggccnnggcaatcggcatcgatctcggcacgacctactcttgcgtcggtgtgtggcagcacgaccgtgtcgagatcatcgccaacgaccaggggtaaccgcaccacaccctcgtacgtcgccttcaccgactccgagcgcctcatcggagatgcggccaagaaccaggtcgccatgaaccccatcaacaccgtcttttgatgccaagcgtctcatttggcaggaaggttttagtggatgccctctggtcccagagtggataattaaggctgttgggccccttcaagggtcatttcctggggcccccggtgaagaaagccaattgatagttggttccgccccaaggggggaaggaaaaaaaaggttttgccacccccaaaaaaaaatctccccccaaggggttccccacaccaaaaaggcccggaaaaaacgccttaaaacctttacccttggggaacccacaaac

SEQ ID NO: 89632 - DNA, 1198 bp, Zea mays
  misc_feature: Ceres CLONE 1577370
  misc_feature: Encodes the peptide sequence at SEQ ID NO. 89633
  misc_feature (12)..(12): n is a, c, t, g, unknown, or other
  misc_feature (18)..(18): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (752)..(752): n is a, c, t, g, unknown, or other
  misc_feature (842)..(842): n is a, c, t, g, unknown, or other
gggagttttggnggtgtntagcgagagtactatttaaactaacaagacggtaaaaaaaaannnnnggggnnnnnnntaggtgggactccccgcggtggcggccgctctagaactagtggatcccccgggctgcaggaattcgtctcacccctagaaaaaattcatccagacaagtcatatctagctatagtagctcccttgagaagcatttgagggaggagccatgtctgaggagaagcaccaccaccacctgtttcaccaccgcaagccagaggaggagggggcctccggcgaggtccactaccaaaagaaggagaagcaccacaagcacatggagaagctcggcgagatcggcgccatccccgccggcgcgtacgccctggtgagaacaaaaaaacaaccccgatctctttgatctcctgaaccatgccaccccatggtcccagtcttgatctttgtgtggctgggcgggggaaaagaacacccgggggcggcccgaaaaagacaagggcccagaaaggccccccaaaaaagagctccgggcaccccgggttcaagggaggagggggggccgcccttcttcccccccgggggggttccccccgggctttcctccttttttccccggggggtgccccctgagaaaaaaaagaagagggcccccagaaaagacacacgccccaaccaaaagtgaaatcccgcgcttcccgggggtggggagcgtggggggccccacacgctgcgtggtcttntttacgaagaagaacgcacaacaactcctttatacgcatttacatactcacatgtagagtgagcccagcagatctccggagacgcgcccncctgtgtgaacattgtattggggggtgggagacactgcagagatcacatttgtgttctcccatgtcggagccgcctctaagacaaaacacacaggggcgttataggcgggcagactaagggccattgatggagggaagtatcctttgcggggtgtagttaataaaaatcaagtacaacgccaggagcgcgtcgcgtccgctaacaataagtggatggtgggtgccgcgaccagacagcgtcattaattatctgttaatagaatggcgctacgccgccccgagtcatcatgagagatattaccacaggacgacgaggggcagaccttacaaacaaggggaggcgatgtcttaccggg

SEQ ID NO: 89633 - protein, 63 aa, Zea mays
  misc_feature: Ceres CLONE 1577370
MSEEKHHHHLFHHRKPEEEGASGEVHYQKKEKHHKHMEKLGEIGAIPAGAYALVRTKKQPRSL

SEQ ID NO: 89634 - DNA, 838 bp, Zea mays
  misc_feature: Ceres CLONE 1577374
  misc_feature (436)..(436): n is a, c, t, g, unknown, or other
  misc_feature (438)..(438): n is a, c, t, g, unknown, or other
  misc_feature (441)..(441): n is a, c, t, g, unknown, or other
  misc_feature (454)..(454): n is a, c, t, g, unknown, or other
  misc_feature (511)..(511): n is a, c, t, g, unknown, or other
  misc_feature (512)..(512): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (552)..(552): n is a, c, t, g, unknown, or other
  misc_feature (553)..(553): n is a, c, t, g, unknown, or other
  misc_feature (559)..(559): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (568)..(568): n is a, c, t, g, unknown, or other
  misc_feature (586)..(586): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (601)..(601): n is a, c, t, g, unknown, or other
  misc_feature (618)..(618): n is a, c, t, g, unknown, or other
  misc_feature (621)..(621): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (650)..(650): n is a, c, t, g, unknown, or other
  misc_feature (671)..(671): n is a, c, t, g, unknown, or other
  misc_feature (699)..(699): n is a, c, t, g, unknown, or other
  misc_feature (700)..(700): n is a, c, t, g, unknown, or other
  misc_feature (710)..(710): n is a, c, t, g, unknown, or other
  misc_feature (761)..(761): n is a, c, t, g, unknown, or other
  misc_feature (762)..(762): n is a, c, t, g, unknown, or other
  misc_feature (804)..(804): n is a, c, t, g, unknown, or other
  misc_feature (836)..(836): n is a, c, t, g, unknown, or other
ctggagctccccgcggtggcggccgctctagaactagtggatcccccgggctgcaggaattcgtctcacccctagaaaaaagcaaaagctgctcatcaccgatggccacggctaacacaagcaagcaagcaagtcgactgagtagctagcagtatatgccaccatgaaaacaacacacaggcacctgcgctaataagctaaacttaaggtagcgcctcactatctccggctagctcggacagacgaccttgccatggctgcgtcaacgtgcgaatcacgcagctatacgagctgctagcacgtaagcagcaagtcagcagcaactagcgctgctgttgcgaatcccctaccctgggggttttccggggggggtcctaaaaaaagggggggggggcgccaaaggggggtaaaaaaatttctccttcctaaaataaananaangaaaaaagagcgncgggggggggcccccccccccccccaaaaatatttaaaaaaaaaatttctcagcccnnccccgagccggagccnnnccccagaggggcnnatnaaaannagtggncccnnnggnaaaggggaggggaggggncgcccccccnnnncnggcgcgagaggaggccnccntaatataaaagggggggggggggnnnagnaggaagggagagggctgtatnccccgcccccccacaccccgcacaaaannaaggaggganaggggggggggggagaggggttaaggggggcgccccccccgaggggggcgnncggggaaggaggaacctttccccacacataattccctccaanacaggaggccacgcggtgtttatttaatatancc

SEQ ID NO: 89635 - DNA, 820 bp, Zea mays
  misc_feature: Ceres CLONE 1577377
  misc_feature: Translation starting site: 101
  misc_feature: Pfam Name: Rubrerythrin Pfam Description: Rubrerythrin
  misc_feature: SWISSPROT Homolog: EC 1.14.13.81 Magnesium-protoporphyrin IX monomethyl ester (oxidative) cyclase
ctccccgcggtggcggccgctctagaactagtggatcccccgggctgcaggaattcgtctcacccctagaaaaagccaccgcccactccgtcgccaaccaatggcctccgccatggagctctcgctcctcaaccccgccgcgacgcaccgccaccgcggcggcctcgccggcctgcccctcgcgcggcgctccgtggtccgcttccgcgtgtccgcctccgccgcggccaccgcgccgcccaagtcctcgggccccaagaagcggggcaagacggagatccaggagacgctgctcacgccccggttctacaccacggacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaggatggagggcccgctccgccagatcttcgtcgagttcctcgagcgctcctgcaccgccgagttctccggcttcctcctctacaaagagctcggccgcaagctcaagaaaaccaacccggtcgtgggcggagatcttctcgctcatgtcaagggacgaggcgcgccatgctggggtcttgaacaaagggctgtctgacttcaacctggcgctgggacctggggtttcctgaaccaaggctaagaaagtaccaccttcttaagcccaaagtcaatcttctaagccaccctacctggtccaaaaaaatcggggactgggagggtacattacccatcttgaagggacctccaaggggaa

SEQ ID NO: 89636 - DNA, 756 bp, Zea mays
  misc_feature: Ceres CLONE 1577379
  misc_feature: Encodes the peptide sequence at SEQ ID NO. 89637
  misc_feature (530)..(530): n is a, c, t, g, unknown, or other
ctccccgcggtggcggccgctctagaactagtggatcccccgggctgcaggaattcgtctcacccctagaaaaaacccagctgcacgctcctcttctcctgctagcagtactgctatatatcaataatactagctggaccctttccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggatgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtngtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaagacagcctggcgttccagtcgcgtctg

SEQ ID NO: 89637 - protein, 49 aa, Zea mays
  misc_feature: Ceres CLONE 1577379
  misc_feature: SWISSPROT Homolog: EC 2.3.1.119 Icosanoyl-CoA synthase
MSRPRPVYLIDFACYKPADELKVSKAEFIDLARKSGKFDEDSLAFQSRL

SEQ ID NO: 89638 - DNA, 843 bp, Zea mays
  misc_feature: Ceres CLONE 1577384
  misc_feature: Encodes the peptide sequence at SEQ ID NO. 89639
  misc_feature (843)..(843): n is a, c, t, g, unknown, or other
tccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctggggaacaacttccccgtcttcttcatccgcgacggcatcaagttccccgacgtgatccacgcgttcaagcccaaccccgcggtcgcacgtgcagggagtactggcgggtgtttcgactttcctgtccgcacctcccccgagagccctgcacaaccttctttcttcctctttcgacgaacgtggggcggtggccgtcggaactaccgcccacctgggaaaggggtttccggccgtgaaacaccgtacacggctttccatgaaccccccggcgggggaaaggggcgcaagtan

SEQ ID NO: 89639 - protein, 232 aa, Zea mays
  misc_feature: Ceres CLONE 1577384
  misc_feature (18)..(232): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPAVARAGSTGGCFDFPVRTSPESPAQPSFFLFRRTWGGGRRNYRPPGKGVSGRETPYTAFHEPPGGGKGRK

SEQ ID NO: 89640 - DNA, 783 bp, Zea mays
  misc_feature: Ceres CLONE 1577385
  misc_feature: Encodes the peptide sequence at SEQ ID NO. 89641
  misc_feature (713)..(713): n is a, c, t, g, unknown, or other
ctccccgcggtggcggccgctctagaactagtggatcccccgggctgcaggaattcgtctcacccctagaaaaagctccactcttctccacgtccatcccgcgccccgaatttcccgagccaactccgccctgccctgtcgctttcccttccacacgcgccgttcgctttgatcgatcaggcaggcatggccgacgagacgaagcaagaagccgccgcccccgcggccgaggtggtcgtgacggaggatgagaagaaggcagaagagaccgccccggtggcggaggaaaaggccgtggaggcggctgtagagaaggccgcggaggcggaggcgggggcggaggaaaaggtcgcggaagcggactcggaggaggagaagaaggcggaggaggccgaggaggccgccgcgggggatgaggcggcggtgatcgatggcactgggtcgttcaaggaggagagtaacctggtgtccgagctccccgaccctgagcgcacagcgctcgcgcagctcaaggagctcgtcgccaccgcgctcgctaacagggagttcaacctgccgccgccgccagcctaggaggaggccaagaacgaggagccggcttaggaagaagctccggcggacaaggatgacgagcccaaggcagatgaggcggctgcccaagagcccgtcaaggaggagggctagcctgaagagccaaaacggaggcgccggcngaagcagcgcccgatgaggtcaggacgagacacccgtgcccgaagagccaagactgaagctcccgcgctg

SEQ ID NO: 89641 - protein, 128 aa, Zea mays
  misc_feature: Ceres CLONE 1577385
MADETKQEAAAPAAEVVVTEDEKKAEETAPVAEEKAVEAAVEKAAEAEAGAEEKVAEADSEEEKKAEEAEEAAAGDEAAVIDGTGSFKEESNLVSELPDPERTALAQLKELVATALANREFNLPPPPA

SEQ ID NO: 89642 - DNA, 1086 bp, Zea mays
  misc_feature: Ceres CLONE 1577391
  misc_feature: Encodes the peptide sequence at SEQ ID NO. 89643
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (69)..(69): n is a, c, t, g, unknown, or other
ggttgtgggtggggggggcttacttcttgtaaatacctctttctgggtgttgagancnnnnnggcaatntttacaaactgggactcaccgcggtggcggccgctctagaactagtggatcccccgggctgcaggaattcgtctcacccctagaaaaatccatccatcacagcttcgagactcgtcctccatgggttctggcggcgtcagatggaaggctctgccgctgtgcctagctctcgtggctctgcaagcatgcctccctgctcgcggggcagctcccaagacttacatcgttcagatggccgcgtctgagatgccgagctcgttcgatttccaccacgaatggtacgcatccactgtgaaatccgtgagctctgtgcagctggaaggagacgcggacgaccattacgccgcgaggatcgtctacaactacgagacggcgttccacggcttcgcggcgaagctggacgaggacgaagcccgaacggatggcccgagccggacgggcgtggtgggcccgtgctccccggaagacgggtcctgcaagctgccacacccacccaggaagccccgggaactttcccctgggggcaattaatcccccgggaaaaaattcagccgaaccaggccttaatggggtgcccggcccggggccccttggggccggaaaaccacggcaacagtttccgcgttccttttcgggggcgggtggggctctccaaaaaaaaccccggggggacaatcttctttgggggcccccccacaaaaaagagagcacccccccacaggccctttttttatgggcccgaaacaaaaaggggggggccctttccgggggcccccctgggtttccccccccggggcacaagaggggtggaaaaaaaaggggcccccgtggggcgccaaaaaaacacggggccccgcgcggggggctttcccccccggaaaacccccaggggttgggaaaaacccccaaaaaaaaatcttttcatggggcccgcccccacttttttttataataaaggggggtaacaaaaagggccctctgttcggggggccccccttttatgtaagaaaaggggcc

SEQ ID NO: 89643 - protein, 136 aa, Zea mays
  misc_feature: Ceres CLONE 1577391
  misc_feature (32)..(101): Pfam Name: Subtilisin_N Pfam Description: Subtilisin N-terminal Region
MGSGGVRWKALPLCLALVALQACLPARGAAPKTYIVQMAASEMPSSFDFHHEWYASTVKSVSSVQLEGDADDHYAARIVYNYETAFHGFAAKLDEDEARTDGPSRTGVVGPCSPEDGSCKLPHPPRKPRELSPGGN

SEQ ID NO: 89644 - DNA, 822 bp, Zea mays
  misc_feature: Ceres CLONE 1577395
  misc_feature: Encodes the peptide sequence at SEQ ID NO. 89645
  misc_feature (822)..(822): n is a, c, t, g, unknown, or other
gagctcaccgcggtggcggccgctctagaactagtggatcccccgggctgcaggaattcgtctcacccctagaaaaaatccatcaccaccacctcctcctccttcccacgactcccgagcgctttctccgcctgcgtgtggcggcagcatggcgactgcgaacgggagcagcaaggggccgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaagcgcgggacatcccgggcgccgcgcacctgctgcgctactaccccggcgcccccgacaaggtgcacggcggcgacgcttcaaatggcgcagcggatgcacgggtacacccctcaaagagccccgtgggcgttggtggggccacatcggggccctgggaactacccccaccacccatggttctttctttaaaggtaagggggcccgcgacttccccaccaagggctggcggcccgctcggttccgtcaaagaccccgccgaaaggcaagaacaccccacccttattccgccagccttcttttcttacaagcggcaacn

SEQ ID NO: 89645 - protein, 224 aa, Zea mays
  misc_feature: Ceres CLONE 1577395
  misc_feature (30)..(210): Pfam Name: Aldedh Pfam Description: Aldehyde dehydrogenase family
  misc_feature: SWISSPROT Homolog: EC 1.2.1.3 Aldehyde dehydrogenase (NAD(+))
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYPGAPDKVHGGDASNGAADARVHPSKSPVGVGGATSGPWELPPPPMVLSLKVRGPATSPPRAGGPLGSVKDPAERQEHPTLIPPAFFSYKRQ

SEQ ID NO: 89646 - DNA, 810 bp, Zea mays
  misc_feature: Ceres CLONE 1577396
  misc_feature: Encodes the peptide sequence at SEQ ID NO. 89647
  misc_feature (810)..(810): n is a, c, t, g, unknown, or other
ctggagctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggagtgtacctggccaccatccccgtcatcgtgctggtgtgcggcgccgagctgggcagcctcagccgcgacgagctgtggcacaaggtgtggggggaggccacctacgacctcgccaccgtgctcggcttcctcgacgtcctcgccttaagcatctccgtctacatcatgtccagggccaggcccgtgtacctcatcgacttgcgatgctacaagccggccgacgagctcaaggtgtccaaagcggagctcatcgtactggggcgcatgtccggcaagttcgacgaggacagtctggagttccagtcgcgtctgctggcctagtccggcatcggcgacgagtcgtacatgccgcgctgcgtgttctagcccaacgccagctgcgccaccatgaaggagggccgcatctgaggcgtccacgggcatggttcgcggcgtn

SEQ ID NO: 89647 - protein, 167 aa, Zea mays
  misc_feature: Ceres CLONE 1577396
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWHKVWGEATYDLATVLGFLDVLALSISVYIMSRARPVYLIDLRCYKPADELKVSKAELIVLGRMSGKFDEDSLEFQSRLLA

SEQ ID NO: 89648 - DNA, 820 bp, Zea mays
  misc_feature: Ceres CLONE 1577397
  misc_feature: Encodes the peptide sequence at SEQ ID NO. 89649
ccgctctagaactagtggatcccccgggctgcaggaattcgtctcacccctagaaaaaaacccccgaccccgaagccccaaacccctaccaccatttcccgggagtctcctttcccggagagtggatccgccactccaatctgcaccattctataaggaaaacctagatccggactcctagccgtcggccatggccacgcgccgggccttctcgtccatcctccgctctgcctctcgcattcgctccgcctcaccgtccccatgcccgcgtgcgccgctccaccaccgcccgtcccccgcgggcttcatactcaaccgtgtagccgcctacgcctcctccgccacggcccaggccgcgcccgctccgccacctccttcaaccggcaagaaaaccggtggcggcaagatcaccgatgagttcaccggcgctggcgccatcggccaggtgtgccaggtcatcggcgccgtcgtggatgtgcgcttcgacgaggggctgcccccgatcctgacggcgcttgaggtgctcgacaacaacattcgcctcgtgctcgaggtggcgcagcacctcggggagaacatggtccgcaccatcgccatggacgggacagaggggcttgttcgcggccagcgtgttctcaacaccgggtctcccatcactgttcctgttggtaggggaaacgcttggacgcattataaaaggtattgggtgagccctattgatgaaaaaggggaaatttaacaaccaaaccactttcctccctaattcatccgggaaacccccagcccttcgtcgaaggcaagcttccagaaggcgccaaaa

SEQ ID NO: 89649 - protein, 182 aa, Zea mays
  misc_feature: Ceres CLONE 1577397
  misc_feature (86)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MATRRAFSSILRSASRIRSASPSPCPRAPLHHRPSPAGFILNRVAAYASSATAQAAPAPPPPSTGKKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRGNAWTHYKRYWVSPIDEKGEI

SEQ ID NO: 89650 - DNA, 835 bp, Zea mays
  misc_feature: Ceres CLONE 1577398
  misc_feature: SWISSPROT Homolog: EC 3.1.3.16 Phosphoprotein phosphatase
  misc_feature (223)..(223): n is a, c, t, g, unknown, or other
tggagctccccgcggtggcggccgctctagaactagtggatcccccgggctgcaggaattcgtctcacccctagaaaaaatttcctgttggcgacgctctcgccaggtcttcggcggcccgttcgtcggcgactagcgcctccgtttgccaggtcttcgtcgtccgttcgccgtcgactggtgcccagcagccaggtacatctggaagaatggtgatttaccnttagcacaccaaaaaccgacaaggtatccgaagatggggaaaacgataaacttaaattcggactttcatctatgcaagggtggcgtgcaactatggaagacgctcactcggctttgctagatcttgacaatgacactgcatcctttggtgtttttgatggacatggaggaaaagtagttcccaaattctgtgcaaaatatctacacatagaagttctccataccgaaccctatgctgctggggacctgggtgctgctgtccacagagcttactttagaatggatgaaatgatgcggggtcaaagaggatggcagggaactcccagcgctttggagataaaataaatcagttcactgggcataacaaaaggccttgattttggtccccttaaggcaggggtttcaaatggatagacctggatgattggggcttccgaaggaggtactttggggaaactggggatggttcccctaaattctaatccccagcctttccatgggtctaggaaaaagcatgggccattttgcctttttatattattttaaattggggccaggccatttgggattttcccttcccctaaaaaggggggccccgggggtttttttcttt

SEQ ID NO: 89651 - DNA, 799 bp, Zea mays
  misc_feature: Ceres CLONE 1577402
  misc_feature: Encodes the peptide sequence at SEQ ID NO. 89652
  misc_feature (474)..(474): n is a, c, t, g, unknown, or other
  misc_feature (528)..(528): n is a, c, t, g, unknown, or other
  misc_feature (740)..(740): n is a, c, t, g, unknown, or other
  misc_feature (743)..(743): n is a, c, t, g, unknown, or other
  misc_feature (776)..(776): n is a, c, t, g, unknown, or other
cccgcggtggcggccgctctagaactagtggatcccccgggctgcaggaattcgtctcacccctagaaaaatcccaaaccgcgcctgttgagctgtctcacagttaactctgtcattgtttccctttttcttcgttgctaggatcagacacaagagttttagtgatgatctcctcatcaacatctctctccatcacaagaagaaggtgtggacaggaagacgacacaagattcaggcgacactcccaccattgctgctgacggcgtccaaattgtcttctttctcccccctaccttggctggctggctctctagatcgaatcacgggtcaggcgctcccctgaccaaggccatgagccactacaccatgcatgcagccatcaactacgccgcgctgccacccacgtcgccgctgcaactccccctcccgtacctccctccgcctcctcctccgccgttaccgctaccgccgctngttgtcgccgccgccaccggcggcggcgtcctctgacgcgggattcccaagcangatcagccccagcgtccttctcatcatcctgatcttggccgtcatcttcttcgtctccggcctgctgcaccttctcgtccggttcctgctccgcccggcgccgcgggatcccggcgacgcgtacgggggtgacgcgaacgctaccgccttccagggtcagctccagcagctgttccaccctcacgacgccggcgtcgaccagtccttcatcnacncgctgccggtgttcctctacggcgccctggtcngcgccggcgggaaagatcctttc

SEQ ID NO: 89652 - protein, 143 aa, Zea mays
  misc_feature: Ceres CLONE 1577402
  misc_feature (35)..(35): Xaa is any aa, unknown, or other
  misc_feature (53)..(53): Xaa is any aa, unknown, or other
  misc_feature (124)..(124): Xaa is any aa, unknown, or other
  misc_feature (125)..(125): Xaa is any aa, unknown, or other
  misc_feature (136)..(136): Xaa is any aa, unknown, or other
MQPSTTPRCHPRRRCNSPSRTSLRLLLRRYRYRRXLSPPPPAAASSDAGFPSXISPSVLLIILILAVIFFVSGLLHLLVRFLLRPAPRDPGDAYGGDANATAFQGQLQQLFHPHDAGVDQSFIXXLPVFLYGALVXAGGKDPF

SEQ ID NO: 89653 - DNA, 814 bp, Zea mays
  misc_feature: Ceres CLONE 1577404
  misc_feature: Encodes the peptide sequence at SEQ ID NO. 89654
  misc_feature (788)..(788): n is a, c, t, g, unknown, or other
tcaccgcggtggcggccgctctagaactagtggatcccccgggctgcaggaattcgtctcacccctagaaaaagtcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggacaaggtgacatgggcactcacccacaacaacctgaatgtatcagtggaaagcgtgatcctgcccgacggtgaaaagtacaaaaatatggacacgctgatgaaggtgtttgacaaggcagtcgagtcccgttttgaccgccggtgcacatttgtagcactgggtggtggtgtcattggggacatgtgtggttttgcagctgctgcattcctccggggcgtcaatttcatacagataccaactactctgatggcccaggtcataagcttgatttatggtccctaaaagtggtttacatataggtttggttctgatngtgctcggatgactgctttaggtgga

SEQ ID NO: 89654 - protein, 217 aa, Zea mays
  misc_feature: Ceres CLONE 1577404
  misc_feature (90)..(218): Pfam Name: DHQ_synthase Pfam Description: 3-dehydroquinate synthase
  misc_feature: SWISSPROT Homolog: EC 4.2.3.4 3-dehydroquinate synthase
MAASASSLLAAPASSSCGAISPQLPRGAPAAASVASPSRHSCYLLRASPSRRHRSRFVANAAPTMQPPAESRVSTVVDVDLGDRSYPIYIGAGLLDEPDLLQRHVHGKRVLVVTNTTVAPLYLDKVTWALTHNNLNVSVESVILPDGEKYKNMDTLMKVFDKAVESRFDRRCTFVALGGGVIGDMCGFAAAAFLRGVNFIQIPTTLMAQVISLIYGP

SEQ ID NO: 89655 - DNA, 850 bp, Zea mays
  misc_feature: Ceres CLONE 1577405
  misc_feature: Encodes the peptide sequence at SEQ ID NO. 89656
tggagctccccgcggtggcggccgctctagaactagtggatcccccgggctgcaggaattcgtctcacccctagaaaaaccccggacctccctagtcccgattcccgaacaagagcgaggccgcactcccccacgagtccactctccgaccgcacgctccgcgacgcgatggccgcgctccgcctcgcctccttcaccctccgccccgccgccgccgccgccgcctcttccggcgcgactccatcggctccccggtccgcctctttctccagcgtggcgcgggggctcccctccctccgcctggccccgccccgccgccgccgcggggacctcgccaggccccgcgccgcggccgaggccgcggcggagagctacgcgtccgcgctgtcggaggtggccgtcgagaacggcaccctcgagcagacggtctccgacctcgagaagctggagaaaagatctctcgacgagccggtcgccgagttcttccacaaccccaccgtcccgcgcgaggagaaggccagctcatccgcgaagatcgcaaagtgtccgagcttcagccgaacgttgtcaacttccttaaagggggcgttgaaaatttcccggggggtcctttggggcccaaaatcgctcctcaaatttcaaaaacccttaaaaattcgccccagggggcccgaggggtcgccacccttaccccccgtttggggaacctgagatcccaggggaacctcccgcaaaattgcccccacacctccccaaaaaaaaaacccggggcccaaaaaaaactccccccccaaaaaaaaaaaaatttccacccgggggtgttattcgggcgggggtttcctccgggggg

SEQ ID NO: 89656 - protein, 180 aa, Zea mays
  misc_feature: Ceres CLONE 1577405
  misc_feature: SWISSPROT Homolog: EC 3.6.3.14 H(+)-transporting two-sector ATPase
MAALRLASFTLRPAAAAAASSGATPSAPRSASFSSVARGLPSLRLAPPRRRRGDLARPRAAAEAAAESYASALSEVAVENGTLEQTVSDLEKLEKRSLDEPVAEFFHNPTVPREEKASSSAKIAKCPSFSRTLSTSLKGALKISRGVLWGPKSLLKFQKPLKIRPRGPEGSPPLPPVWGT

SEQ ID NO: 89657 - DNA, 780 bp, Zea mays
  misc_feature: Ceres CLONE 1577406
  misc_feature: Encodes the peptide sequence at SEQ ID NO. 89658
  misc_feature (671)..(671): n is a, c, t, g, unknown, or other
ctccccgcggtggcggccgctctagaactagtggatcccccgggctgcaggaattcgtctcacccctagaaaaaaaaaaccgccacgtgccatatccggtgatacgcctccccggcctctcgtgtctcgtcgtctccctctccctccacaacggcatagctgcagcagccaagtcctctccgctctcttcgccgccaccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaatgtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagccagtccaagatcgcttccaagctatcgcccatatctgatgaaaatacagtgcttgatttggttatcatttgggtgtggtccagctggtnctttctctagcttcagagtcggctaagaaaggtctcactggtagtctcattgggcctgaacctccatcacaaataacatggtgtgggggggaagggtgaaattttaaaa

SEQ ID NO: 89658 - protein, 130 aa, Zea mays
  misc_feature: Ceres CLONE 1577406
  misc_feature (128)..(128): Xaa is any aa, unknown, or other
MGLSGATISAPLGCCVLRCGAVGGGKALKADAERWRRAGWSRRVGGPNVRCVATEKHDETAAVGAAVGVDFADEEDYRKGGGGELLYVQMQSTKPMESQSKIASKLSPISDENTVLDLVIIWVWSSWXFL

SEQ ID NO: 89659 - DNA, 785 bp, Zea mays
  misc_feature: Ceres CLONE 1577407
  misc_feature: Translation starting site: 298
  misc_feature: Pfam Name: zf-BED Pfam Description: BED zinc finger
ccccgcggtggcggccgctctagaactagtggatcccccgggctgcaggaattcgtctcacccctagaaaaaagccacgagtaccctccggttcctctctctccacgggtcgaagcccctctctcccggatcgtcctctcccccacaggatctagggtttgctcgctcggccttcgtccttcttgggccgagccctaattcttctgcaccgccacccagcaggcttcggtttggttcgcatccgctgcgcccgcttcgtccccgtattcttggattccattggcttctatcttcagcatggatgagccaaacaacaattttaatgcaacggtgcatgccaatgagatgtttgatagcaatggtgtgatccatgaagatgagatggcccatgacgatgagatgatccatggccatgcgatgttccttggcgatgagatgattcgtgggaccgagatggttgaaggaagtgagatgatccatggtcatgatatggttcaggttaatgatctcatccacggcaatgagatggttccagttcacgacatggtcaacggtgacaagatagcccatggtaatgaattggttaatgctcagatgaccccacgaatatcaagacgtcggaagaagaagtcgctagtttgggagcacttcactatagaactcatgccagggggaagttcaagagcatgctgcaagttatgcaagcaaaacctttgcgtatagttctggctcaaaaattgcaggcactagccatctcaagcggcacatcacactagggctcctgt

SEQ ID NO: 89660 - DNA, 768 bp, Zea mays
  misc_feature: Ceres CLONE 1577410
  misc_feature: Encodes the peptide sequence at SEQ ID NO. 89661
ggagctcaccgcggtggcggccgctctagaactagtggatcccccgggctgcaggaattcgtctcacccctagaaaaaaactactagaacggggcggttacgctctctccttcggtcgaagcccctctctcccggatcgtcctctcccccacaggatctaaggattgctcgctcggtcttcctccttctggggcagagccataattattctgcaccggcacggtgcaggttgcgatttagatcaacatcctgggtcccctggacgacaacacactcaaggagctgcttgagctgactcgtggcgactcctcaagcgaccggccagggcttgacctggtggccgcgcttgacatgagcgatagcatgggtggggagcatatcgataagatgaacactgccctaaaatatgaggcgaagacattcaacttcctctaccgactatacgacttcagctacctggacaccgccaacgagatcagaccactgcggccagtgaccgaggactgccaaccgtatctgctgaagctcatcgacggcctccagcccggaggcgactccaagatcagcgacagcctccagacagggctcgaggtccgctccgaccacaagctcaacttcagtcgcgtcgatgaagacatgctcatgtgcgagcgccttcatatcggggcgagccaggcggaaacgtcaagatctgctacatgtcagggtaccacatctgggtctgagcgtacgactaccacactgtggctaatagccgtggtcaagcaa

SEQ ID NO: 89661 - protein, 139 aa, Zea mays
  misc_feature: Ceres CLONE 1577410
MSDSMGGEHIDKMNTALKYEAKTFNFLYRLYDFSYLDTANEIRPLRPVTEDCQPYLLKLIDGLQPGGDSKISDSLQTGLEVRSDHKLNFSRVDEDMLMCERLHIGASQAETSRSATCQGTTSGSERTTTTLWLIAVVKQ

SEQ ID NO: 89662 - DNA, 788 bp, Zea mays
  misc_feature: Ceres CLONE 1577412
  misc_feature: Encodes the peptide sequence at SEQ ID NO. 89663
  misc_feature (516)..(516): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (710)..(710): n is a, c, t, g, unknown, or other
  misc_feature (718)..(718): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (761)..(761): n is a, c, t, g, unknown, or other
  misc_feature (763)..(763): n is a, c, t, g, unknown, or other
  misc_feature (765)..(765): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
ctcaccgcggtggcggccgctctagaactagtggatcccccgggctgcaggaattcgtctcacccctagaaaaaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggcccccagaacgggacccccgaggcgaagaagaagtacgcggccatctgcgtcaccatgcccaccgccaaggtctgccacaactgagcacgcccgcgttgcagctgcaggccnggggggtggtatataattaatgtacgtgccaacgtgggtgttgtcccctaatgttgggtccaggcttaaaatgcatgccctgacgggaggcccccttaattggttttttgaccggcctccgagcttgtaagaaaatcaagtgccctggccaaaatggaattccgggtgggaaaaaaaaaaaaaaaaaannnannaaaaaaanaaaaaaaaaaannnnnnaaaaaaaaaaaaaaaaaaaataattntngnagnnngaaaataaaaaaaaaggg

SEQ ID NO: 89663 - protein, 104 aa, Zea mays
  misc_feature: Ceres CLONE 1577412
MASLTMMASFAAVAVAAPSRRGTFAVVRSAKVDRCQEPATLAATEARPAADGRRAVMLAAAAAAVAAIGGAGAAMAGPQNGTPEAKKKYAAICVTMPTAKVCHN

SEQ ID NO: 89664 - DNA, 874 bp, Zea mays
  misc_feature: Ceres CLONE 1577413
  misc_feature: Encodes the peptide sequence at SEQ ID NO. 89665
gcggtggcggccgctctagaactagtggatcccccgggctgcaggaattcgtctcacccctagaaaaagcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcatgcttggtaccactgtgatcataccaactgcacttgttccacaaatgggaggaaacaatgaggacaaagcagtggttatccagacattgctgttcgttgcaggtatcaacaccctcctgcagagtttctttggtaccatgttgcctgcagtgatcggcgggtcatacacctttgttctgcctaccatttcgatcatccttgctggacgttatgctaatgaacctaatccacatattaaatttctccgcatcatgcgggggacacaaggggcgttggattgtggcttccagcctttacagattataagtgggcttcaggtggccttttggcgtaatgttggcccgggtatcttgaattccccttttcacctggctccttttgggtggcccctaagttgggaattggggacttggtatgaaagctagggattttccccttcggtttggccccaaatggtggtttgaagaatttgggttcttaaccctccaagcttcgatccccttgttttggggggagaccttttttacaaatgg

SEQ ID NO: 89665 - protein, 192 aa, Zea mays
  misc_feature: Ceres CLONE 1577413
MAGGGGGGAAPKHDDFTPHPVKDQLPGVSYCITSPPPWPEAVLLGFQHYLVMLGTTVIIPTALVPQMGGNNEDKAVVIQTLLFVAGINTLLQSFFGTMLPAVIGGSYTFVLPTISIILAGRYANEPNPHIKFLRIMRGTQGALDCGFQPLQIISGLQVAFWRNVGPGILNSPFHLAPFGWPLSWELGTWYES

SEQ ID NO: 89666 - DNA, 801 bp, Zea mays
  misc_feature: Ceres CLONE 1577414
  misc_feature: Encodes the peptide sequence at SEQ ID NO. 89667
  misc_feature (608)..(608): n is a, c, t, g, unknown, or other
ctggagctccccgcggtggcggccgctctagaactagtggatcccccgggctgcaggaattcgtctcacccctagaaaaatcgtggcctcacgctcacgctcacgctggttgctcctcctcccccccatccctccgcccctcccatggcgtccctcttcggggctcgccgccggcgatcgccggagtacgacggcgaggacgatagatccggcggagggagggccaagcgccggcgcctgtcgccggaggaggcggcggcgtcgccggcggagccgggcgcggcgacggggactagccacggctggctctccggcttcgtctccggagcgaagagggccatttcttccgttttgctgtcctcttcgcccgaggagaccggctcgggggaggacggggcaggtggaaggaggacgactaccacgtatccgaggagggcatcaactggaatgagactgcatgatttcctgttccctcccgggggagacaggccccttattgggaggcccaacttgctatctgaccagaccgggggggaagggaaaacatttctccaggggatgaactggggaatgggttggccccaacttattgaaatccaagcattttnaaaggtttctccctgccgtgaaagcccgtggagaatgggaaagctgagaagaaatttcccacgttgagaaatgccgggcctttccccggggaacttccaaggggggcttggccccctccctttgaacccgggaaaaggaaatttcccctgaaatcgggtccctttttctttttttttttgaaatgggggtccc

SEQ ID NO: 89667 - protein, 176 aa, Zea mays
  misc_feature: Ceres CLONE 1577414
  misc_feature (155)..(155): Xaa is any aa, unknown, or other
MASLFGARRRRSPEYDGEDDRSGGGRAKRRRLSPEEAAASPAEPGAATGTSHGWLSGFVSGAKRAISSVLLSSSPEETGSGEDGAGGRRTTTTYPRRASTGMRLHDFLFPPGGDRPLIGRPNLLSDQTGGEGKTFLQGMNWGMGWPQLIEIQAFXKVSPCRESPWRMGKLRRNFPR

SEQ ID NO: 89668 - DNA, 794 bp, Zea mays
  misc_feature: Ceres CLONE 1577416
  misc_feature: Encodes the peptide sequence at SEQ ID NO. 89669
  misc_feature (729)..(729): n is a, c, t, g, unknown, or other
ctccccgcggtggcggccgctctagaactagtggatcccccgggctgcaggaattcgtctcacccctagaatagaaaaacctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggagggtcacggcagcaacaactgggagggtctgctggaccccatcgacggcgtgctcctccaggagctcatccgctacggcgagttcgcccaggccacctacgacagcttcgactacgaccgcttctccccctactggcgcagctgcaagtacccggcgaagactttcttcacgaagtcgggcctcgcgggatcggctacgaggtacccgctacctctacgcancctgaaacgaattcaagttccccaatttccggatcaagacggccgccaaagccaagatgttgagt

SEQ ID NO: 89669 - protein, 177 aa, Zea mays
  misc_feature: Ceres CLONE 1577416
  misc_feature (156)..(156): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREGHGSNNWEGLLDPIDGVLLQELIRYGEFAQATYDSFDYDRFSPYWRSCKYPAKTFFTKSGLAGSATRYPLPLRXLKRIQVPQFPDQDGRQSQDVE

SEQ ID NO: 89670 - DNA, 754 bp, Zea mays
  misc_feature: Ceres CLONE 1577419
  misc_feature: Encodes the peptide sequence at SEQ ID NO. 89671
ctccccgcggtggcggccgctctagatctagtggataccgcgggctgcacgaattagtctcaccccgataatacaaaaagctagaaaaaaccgagctcaaacacacctctcgaaagcaggagagataagacgtgtaacgagctagccactcgcgcacgcgcacgagtgagtctagactagattacactcgcgttctagacaatatcacagcgtcgtgctgtgtgatctctgaccgggttgactactaccgcagcaccaagcatctgatggcggcctccgtatgtatcctgactgatgctcggccccaccgtgcaggtaccgggccggagtggttcgccaacagtgtggcactgactaacacgcttcagcgccgtcgactttctggccgctatcttgtcgtcacctccgccacaacagccgaagtgaggcctcccctgtgtacgatcgaggacgtggacctcatctctcatcatgcctcggccgacgacggggagctaaccccgcggtgtgaggaggtccatggcactacaactgggaaggtctgctggacccggtcgatggggtgatcgtcccagaaccttttcccctttccgaaaaggttgcccaagcccaaactggcgaaaaggttaaaacttaagaacggcttttctctccccttacgacggccaggttggaaaattttcccggggaaaaaaaaacccttcttttttcttcggaacccctccgggcccgtcccggaagaggccattccaga

SEQ ID NO: 89671 - protein, 99 aa, Zea mays
  misc_feature: Ceres CLONE 1577419
MAASVCILTDARPHRAGTGPEWFANSVALTNTLQRRRLSGRYLVVTSATTAEVRPPLCTIEDVDLISHHASADDGELTPRCEEVHGTTTGKVCWTRSMG

SEQ ID NO: 89672 - DNA, 797 bp, Zea mays
  misc_feature: Ceres CLONE 1577425
  misc_feature: Encodes the peptide sequence at SEQ ID NO. 89673
ctccccgcggtggcggccgctctagaactagtggatcccccgggctgcaggaattcgtctcacccctagaaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggggggtcgttcactgttactcgtgacacgtctggggagcagcttggcaggggtactaagattacactttttcctaaaggaagatcagtttagaatactttgagggagcgtccgcctcaaaggatttggggcaagaaagcacctctgagtttcatcaggcta

SEQ ID NO: 89673 - protein, 184 aa, Zea mays
  misc_feature: Ceres CLONE 1577425
  misc_feature (28)..(182): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFPKGRSV

SEQ ID NO: 89674 - DNA, 828 bp, Zea mays
  misc_feature: Ceres CLONE 1577429
  misc_feature (705)..(705): n is a, c, t, g, unknown, or other
ctcaccgcggtggcggccgctctagaactagtggatcccccgggctgcaggaattcgtctcacccctagaaaaactagaaaaatttccagaatctaaataaaggagtccgtgggaatcaggtatcacttttgaacattgttgttgaattgaagaaatgctgcaaccatccatttttgttcgaaagtgccgatcacggttatggtggagatagcattggcgatcggaataaagttgaacggattgttatgagtagtggtaaacttgtcttgttggacaaactattggtgagactacgggagactaaccatcgtgtgcttatattctcacagatggttaagatgttggacatccttgcagaatatctctcccttcggggatttcagtttcagaggcttgatggtagtacaagagcagatcttcgtcatcaagccatggaacattttaatgctcctggaagtgatgacttctgttttcttttatccacacgtgccggaggacttggtattaatcttgcaactgcagatacagtgataatttttgattcagattggaatccacaaaatgatctgcaggccatgagtagggcacataggattggccaacaggaaactgttaatatctaccgcttcgtcacatgcaaaagtgttgaagaagatattttgggaacgcgcaaagaaaaaagagggttcctggatcccttgggntattcagaagcctaaatgcctgagggccagggctttgagaagaaaagaatcccaaaaaagggggggcttccattattttgacaaggaatgaaacttttcgggcttatcctttgaagggttggt

SEQ ID NO: 89675 - DNA, 838 bp, Zea mays
  misc_feature: Ceres CLONE 1577433
  misc_feature: SWISSPROT Homolog: EC 3.2.2.22 rRNA N-glycosylase
  misc_feature (827)..(827): n is a, c, t, g, unknown, or other
ctccccgcggtggcggccgctctagaactagtggatcccccgggctgcaggaattcgtctcacccctagaaaaattccatccccaaccaaaatagttccgatctatgaaatctattacctcccgcgctctgtacagtctggatcctcctgaacctccaagcaccaagcgatgaaaggagggacgcaagctattagcctgatggtgcaccttgctgtgccatggatctgacttgcttcttgggcagctctgctaacaacgctagcatctggaaatgtgggtgcagcagctccgatactgatagcagattacataaaatctgaacttcaacaccgcttcggcgaccccctacaagtacaagagcttcatcacttctgttcgagctggcttggtgagctaagcgaggggcaacagcagcgggatccccgtgctggtcgacgaagacgatccgctcgcgctcgaatcgtttctaaacatcactctggtgaacaacggagggcgctccgttagcttgtagatggatgtctccagagcctacttcgtggcttacatagcaggacagcgctcgtgcctcctcaagagatcaggccgcactttctcgtcagcgatctgttactacggcggcccgtggggaacaagttcggctcctggtactcgacctgctgctgcttgcagctacagcttaggatcttggtggtcccgcattgcctagatagatatctcgaagaagcccacctcgtcccctgtgcctggttcccaactgggaaacgctttccgaagtatgatctgaaaacgggggggttccccccgcccggcgtaaatgtatggngggccaagcgc

SEQ ID NO: 89676 - DNA, 796 bp, Zea mays
  misc_feature: Ceres CLONE 1577435
  misc_feature: Encodes the peptide sequence at SEQ ID NO. 89677
  misc_feature (653)..(653): n is a, c, t, g, unknown, or other
  misc_feature (761)..(761): n is a, c, t, g, unknown, or other
  misc_feature (762)..(762): n is a, c, t, g, unknown, or other
  misc_feature (794)..(794): n is a, c, t, g, unknown, or other
  misc_feature (795)..(795): n is a, c, t, g, unknown, or other
ggagctccccgcggtggcggccgctctagaactagtggatcccccgggctgcaggaattcgtctcacccctagaaaaagccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggcnaggccaggcgtgctcgtcggcgaccacaagaagtaggccgtcgtctaggagctcggcgacgcgctgcccgaccgtgggagacatattctgaggccgtagaacgcatgnnttagccttgtcatgcccagcgaggttcagtgnnt

SEQ ID NO: 89677 - protein, 176 aa, Zea mays
  misc_feature: Ceres CLONE 1577435
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMARPGVLVGDHKK

SEQ ID NO: 89678 - DNA, 821 bp, Zea mays
  misc_feature: Ceres CLONE 1577436
  misc_feature: Encodes the peptide sequence at SEQ ID NO. 89679
tccccgcggtggcggccgctctagaactagtggatcccccgggctgcaggaattcgtctcacccctagaaaaaaagggcccaaggcttctctatctagggattcatcttcctctcgtcttccctcttcctctccgaggatacaaggcgccgtcccaggtagaggtagggtcgctaccatgctggaggagctgcccatcgacgccctcatccgctcctgtctcctcgaggagcgatccgccgacgccagcttctcccaggacaattacgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgactttggggacatcttccgccagctccaccgcgaggccgaggcgcgcgccgaggaaatgaagaagtccaagcaggccctctcgtcccgtccacagcctgctctcacccagaagaagcctggtcccaagggccgcggcggtgattcccgcggcggcgctgctaacaagggcggctctggtgccaaggatgactctgatggtgacggctatggcaaccaggaccaccgtactctggcaaatggtgccttcaaggggccagaggatggcgtccgcaaggagaatcttctcatggccgcactgttggtgtcaagggaaaggagaatggggccccccaagatgaaggggccttccatgttaagtaactaccgaagctacggggcaaccaaaaaaaatggtgcccctga

SEQ ID NO: 89679 - protein, 214 aa, Zea mays
  misc_feature: Ceres CLONE 1577436
  misc_feature (2)..(192): Pfam Name: SRP-alpha_N Pfam Description: Signal recognition particle, alpha subunit, N-terminal
MLEELPIDALIRSCLLEERSADASFSQDNYALKWTFHNDLGLVFVAVYQKILHLLYVDDLLAAVRKEFSQIYDPKRTSYDDFGDIFRQLHREAEARAEEMKKSKQALSSRPQPALTQKKPGPKGRGGDSRGGAANKGGSGAKDDSDGDGYGNQDHRTLANGAFKGPEDGVRKENLLMAALLVSRERRMGPPKMKGPSMLSNYRSYGATKKNGAP

SEQ ID NO: 89680 - DNA, 798 bp, Zea mays
  misc_feature: Ceres CLONE 1577437
  misc_feature: Encodes the peptide sequence at SEQ ID NO. 89681
ctcaccgcggtggcggccgctctagaactagtggatcccccgggctgcaggaattcgtctcacccctagaaaaaaacgcaacggcctcgccccgctttataggccgccgcccgcgccacatcgccaccgtctcgcaccgtcgctgccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtgggtccggggactcaagcttttccctctcacaagcacaaagggcaccccctgctgttcttattggaagatgttacagggcttattgatatcccccatgagccaattgtttcaacagggggcataaaaaaaaaaatttggttaatgaactcaggttcaaactcaactttctccttaaaccggcaaattccatcggtaacctatcctggggggggggggggaatccaaattccaccggaaagggaaccttgtttaaagggggcttggctttcaaaaaaaaaaattggccgggggga

SEQ ID NO: 89681 - protein, 97 aa, Zea mays
  misc_feature: Ceres CLONE 1577437
  misc_feature: SWISSPROT Homolog: EC 2.7.7.27 Glucose-1-phosphate adenylyltransferase
MGVRRMRINCCSIRRNKALRRMCFSARGAVSSTQCVLTSDAGPDTLVVRTSFRRNYADPNEVAAVILGGGSGDSSFSLSQAQRAPPAVLIGRCYRAY

SEQ ID NO: 89682 - DNA, 764 bp, Zea mays
  misc_feature: Ceres CLONE 1577439
  misc_feature: Encodes the peptide sequence at SEQ ID NO. 89683
acccgcggtggcggccgctctagaactagtggatcccccgggctgcaggaattcgtctcacccctagaaaaactcgcctcgtctccgtcgtcagtcgcctagctagcttccctcacaagcagcaaggcgggagcgaacacgccggcgaccgttagctcgacgcctcgaccgacctccgcgccgtcgctccgcccttgcaaagccgcagccgcgcgcttttatgctcgcggcagctcggtttgtggtctctactagcggtatcctctcgccctcggacctttctgcgaaagcgaagattccggtatggaggtggaggcgacgcccacgacggccgtgtcatcttccggcgtggccgcgcagctgccgccgcccggcccgcccgccaagaaaaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagctccaccggcggggccacaacctgccgtggaagctgcggcagcggagccgcaaagaggtccggaagcgggtgtacgtgtgcccggagcccagctgcgtgcaccacgacccggtcgcgcgcgctcggcgacctcaccgggatcaagaaagcactcctgcccgcagcacgggcgagaaaaaatgggaggggcgacaagtggctccagaaagtaccccctgccaatcggactgggaagcgcccca

SEQ ID NO: 89683 - protein, 153 aa, Zea mays
  misc_feature: Ceres CLONE 1577439
  misc_feature (57)..(79): Pfam Name: zf-C2H2 Pfam Description: Zinc finger, C2H2 type
MEVEATPTTAVSSSGVAAQLPPPGPPAKKKRALPGMPDPDAEVIALSPKTLLATNRFVCEICNKGFQRDQNLQLHRRGHNLPWKLRQRSRKEVRKRVYVCPEPSCVHHDPVARARRPHRDQESTPARSTGEKKWEGRQVAPESTPCQSDWEAP

SEQ ID NO: 89684 - DNA, 813 bp, Zea mays
  misc_feature: Ceres CLONE 1577440
  misc_feature: Encodes the peptide sequence at SEQ ID NO. 89685
ctccccgcggtggcggccgctctagaactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacacttttgaaagctgctctcttctgctctgcgtttgtgatttctgcactcaagcttctcttgcctgtgcactcaagcttctctcttcctggacaactagtgatctccttgaagcatttcagcttttacctagagaatcttttctgtgatgctgaaggcaagagaggcttttagggtgatggcgcaaaactagcctgccctcctggttttc

SEQ ID NO: 89685 - protein, 29 aa, Zea mays
  misc_feature: Ceres CLONE 1577440
MSAEVAGGHPYFLSCYFWFIYCIKFRDFT

SEQ ID NO: 89686 - DNA, 785 bp, Zea mays
  misc_feature: Ceres CLONE 1577443
  misc_feature: Encodes the peptide sequence at SEQ ID NO. 89687
  misc_feature (551)..(551): n is a, c, t, g, unknown, or other
ctccccgcggtggcggccgctctagaactagtggatcccccgggctgcaggaattcgtctcacccctagaaaaaaaaaatctgacccgggccaccgtcggcactgctctgacatggcgatccgctccaaggcctggatctcgctgctgctagcgctcgccgcggtgctctccgcccgggcggaggagcccgccgcggcggaggctgaggccgtgctcaccctcgacgtcgacagcttcgacgaggccgtcgccaagcaccccttcatggtcgtcgagttctacgccccatggtgtggacattgtaagaaccttgctccagagtacgagaatgcggccaaggaacttagcaagcatgacccaccgattgttctcgctaaggttgatgctaacgaggagaagaacaggccgcttgctaccaagtacgagatacaagggttcccaaccctcaagatcttcaggaaccaggggaagaacattcaggaatacaagggccctagggaggctgatggcattgtggattacttgaagaagcaggttggccctgcgtccnaggagatcaagtcagcagaaggtgtggcccgcccattttgatgacaaagaagatctatattcgttgggaatctttcaaagaaaatccaggggccctggaatttccaaacctcagtggaacttgcctgaaaaaccgaaattccgaattttggaactttgggaaaacccttttggaccccaaaccccctccccccctggggggaatcccctttggggagggggcccttgtatccgg

SEQ ID NO: 89687 - protein, 159 aa, Zea mays
  misc_feature: Ceres CLONE 1577443
  misc_feature (33)..(141): Pfam Name: Thioredoxin Pfam Description: Thioredoxin
  misc_feature: SWISSPROT Homolog: EC 5.3.4.1 Protein disulfide-isomerase
  misc_feature (147)..(147): Xaa is any aa, unknown, or other
MAIRSKAWISLLLALAAVLSARAEEPAAAEAEAVLTLDVDSFDEAVAKHPFMVVEFYAPWCGHCKNLAPEYENAAKELSKHDPPIVLAKVDANEEKNRPLATKYEIQGFPTLKIFRNQGKNIQEYKGPREADGIVDYLKKQVGPASXEIKSAEGVARPF

SEQ ID NO: 89688 - DNA, 850 bp, Zea mays
  misc_feature: Ceres CLONE 1577447
  misc_feature: Encodes the peptide sequence at SEQ ID NO. 89689
ctccccgcggtggcggccgctctagaactagtggatcccccgggctgcaggaattcgtctcacccctagaaaaatccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcgggctcggggccgccgtgctcagccgcacgctcacgttcgccgcgggcttctcggcccttcggcgacccgatccccctggctcatcggggctcgccttctttctttgcgaagggggttcatcaaaaaccgggcctcgggcttcccgcgttcgcccaacgccctttcgtcggccgccctttcgggggtcctccctccccttcgggccttgggagtaacttcggttgggtttttgggcgaa

SEQ ID NO: 89689 - protein, 237 aa, Zea mays
  misc_feature: Ceres CLONE 1577447
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWLIPPPAGVPRNAWQLLAIFLSTIVGIITQPLPLGAVALLGLGAAVLSRTLTFAAGFSALRRPDPPGSSGLAFFLCEGGSSKTGPRASRVRPTPFRRPPFRGSSLPFGPWE

SEQ ID NO: 89690 - DNA, 1099 bp, Zea mays
  misc_feature: Ceres CLONE 1577449
  misc_feature (55)..(55): n is a, c, t, g, unknown, or other
  misc_feature (59)..(59): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (904)..(904): n is a, c, t, g, unknown, or other
  misc_feature (1075)..(1075): n is a, c, t, g, unknown, or other
ttagttttttatatcaaagtcaacgagaaataaaaaagataaagagaataaaaantttntcttggcagaannnaaaactgggactccccgcggtggcggccgctctagaatagtggatcccccgggctgcaggaattcgtctcacccctagaaaaaccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgcccgctccagcaccggccgccccgccgaagaagcccgcgctgcagggcgcggccatcaagccgctcctggcctccatcgcgactggcgtcctcatctggggctcatccccgccccccgcccggcgtgcccccgcaacggcgtgggcaggttccttagccatacttccttctccaaccattcgtccgggcatcattcaccccaaaccgtcttgcccccttcgggcagcgaggtacgaccacttccctccgggacctttcgggcgttccggcccccttggctatcaaaacccggatagacacattcataggtttttcgacccaggcggaccccttttctttctgggcctcttttcggagggaaacaccccgaattcccccccgtgggatataaaattgaggaggactcaagcccctttctttttcctttncaagcagaaaggggggaggtttcacattataaaatagaccggggtgccctttcgagaacgttcccggtcgatatctgcctcgctgaaaacagcccattattctcttacgacccgacccctcttttccggggggtatgctttatcttctcaccactttgggagaggcctacnaggggaaaataaacccgcccagca

SEQ ID NO: 89691 - DNA, 2667 bp, Zea mays
  misc_feature: Ceres CLONE 1577450
  misc_feature: Encodes the peptide sequence at SEQ ID NO. 89692
gccagagagggtgagggattgccgtgaccgattcgaaagccgcttcgggcgcgggtgggatcggcccgtggccggcggagatgtccggattcgtcggtgtcgtcgtgtccgacccctcgctgcaggggcagttcacgcaggtcgagctccgatcgctcaaggccaagttcgtgtctctgaagagagattccggccatgtcaccactaagaatctcccggtgatgatgaagaagctgagggggctcaatgaggtggtctctgtggaggagatcgcggccttcctgtccgagtcgtaccccgacagcgatcaggagattgaattcgaatccttcctccgggagtatctgaatctgcaggcgcgggtgagtgccaaggagggtggtgccggcggtggccggggtggcaagtcgtcgttcctcaagtccagcaccactacgctgctgcacaacctcaatcaggcagagaaatcttcgtatgtggcgcacatcaatacttacctccgtgaagacccattcctgaagaagtacttgcccatggacccgtctggaaaccagctgttcgatctcatccgggatggtgttctgctctgcaaactgatcaatgtagctgtacctgggaccattgatgagagggcaataaataagaaaagagttcttaacccatgggagagaaatgaaaatcacacgctctgcctcaattccgccaaggccattggatgcactgttgtcaacattggcacacaggatttggtggagggaaggcctcatttagttcttggattgatatcacaaatcataaagattcaacttttagctgatcttaacctcaagaagacaccacagctggtggagctatttgatgacagcaaggatatagacgaggttttgagtttgtcgccagaaaagatgctacttcggtggatgaaccatcatctgaaaaaagctggctacaagaaaactgttaacaatttctcttcagatgtgaaggatggtgaagcgtatgcttaccttctgaaagctcttgctccagagcattcccctgaaactacattggacaccaaggatccgaatgagagggcaaaactagtacttgaacaagcggcgaagttggactgtaagagatacttgaccccgaaggatatcactgagggatctgccaatttaaatcttgcatttgttgcacaaatattccagcataggaatggtctcaccagtgacaccaaacaagttactctcacacagaccgcaacacctgatgatgttctagtatctagagaagaaagagcctttcggatgtggatcaacagccttggggttgaatcatatgtaaacaatgtctttgaagatgttcgcaatggatgggtacttcttgaagtgcttgacaaggtgtctcctggatctgtcaattggaagctggcaacaaaacctccaattaaattgccatttagaaaactggagaattgcaatcaagttgtaaaaattgggaagcagttgaagttttctttagtaaatctggctggaaacgatattgttcagggaaataagaaattgattgttgcacttctgtggcaattgatgagattcaatatcctccagctgttaaacaaactgagattccactcccaaggagggtcccaaggaaaagaaatttctgatgctgatattctagactgggccaacagcaaagtgaaagcgtccggaagaacatctcgaatggaaagtttcaaggacaagagcttatcaaatggattgttcttcctcgagcttcttagcacagtacagccaagggttgtgaactggaaagttgttactaaaggggaaactgatgaggacaagaagctgaatgctacgtacatcattagtgttgcaaggaagattggatgctctgtgttcctgttgccagaggacatcgtcgaggtgaatcagaagatgattctaacacttaccgctagcattatgtattggagcctacagaatcagcatcagtcacagtctgaaatgccagagcaatcagaaccatctagcatggcttcagacgcagcctctgacattgcctcggaggacggtgcttcaacgacagcaccatctgagttggatgaggtgaactcgctgtctgatagcgtatccaatttgacaacggatgatgctacttcaaacgccccatccactgaaaacggaaatggtgtggcagggtcctgatggttatagttatgcagacccagttctttttcccacacacagtgctgctttttttatacagggaacagtgcttttcatggtgctcaaagtcgtcgctaccagaagkggttttttttttaatacttctgcttcatgagtatggtagcttgatagatacagcaagtgcagatagatatagatgccctttgttcatggaatctgcttagactatagggggcggggcgggaaagatagtatatgtcgctggccgggtagtttctgtatttgtggcacacgcacccatgcaaggttttacctctttatgtatcttgtcggtcaattcgttcatatgtttattggactggtcatcgcttgtaatgctgttgctgctctgaaccgtgcctgwacataacatacactcaaaagggtttttgctttctccccaaaaaaaaaaaaaaaaaaaaaaaaaaaagaaaaaaacaaacaaaat

SEQ ID NO: 89692 - protein, 705 aa, Zea mays
  misc_feature: Ceres CLONE 1577450
  misc_feature (398)..(503): Pfam Name: CH Pfam Description: Calponin homology (CH) domain
  misc_feature (127)..(243): Pfam Name: CH Pfam Description: Calponin homology (CH) domain
  misc_feature (272)..(374): Pfam Name: CH Pfam Description: Calponin homology (CH) domain
  misc_feature (523)..(630): Pfam Name: CH Pfam Description: Calponin homology (CH) domain
MSGFVGVVVSDPSLQGQFTQVELRSLKAKFVSLKRDSGHVTTKNLPVMMKKLRGLNEVVSVEEIAAFLSESYPDSDQEIEFESFLREYLNLQARVSAKEGGAGGGRGGKSSFLKSSTTTLLHNLNQAEKSSYVAHINTYLREDPFLKKYLPMDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPNERAKLVLEQAAKLDCKRYLTPKDITEGSANLNLAFVAQIFQHRNGLTSDTKQVTLTQTATPDDVLVSREERAFRMWINSLGVESYVNNVFEDVRNGWVLLEVLDKVSPGSVNWKLATKPPIKLPFRKLENCNQVVKIGKQLKFSLVNLAGNDIVQGNKKLIVALLWQLMRFNILQLLNKLRFHSQGGSQGKEISDADILDWANSKVKASGRTSRMESFKDKSLSNGLFFLELLSTVQPRVVNWKVVTKGETDEDKKLNATYIISVARKIGCSVFLLPEDIVEVNQKMILTLTASIMYWSLQNQHQSQSEMPEQSEPSSMASDAASDIASEDGASTTAPSELDEVNSLSDSVSNLTTDDATSNAPSTENGNGVAGS

SEQ ID NO: 89693 - DNA, 810 bp, Zea mays
  misc_feature: Ceres CLONE 1577451
  misc_feature: Encodes the peptide sequence at SEQ ID NO. 89694
tccccgcggtggcggccgctctagaactagtggatcccccgggctgcaggaattcgtctcacccctagaaaaagtctagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtgggcaactacgtcacccgcatgggcctcggcacgccggccaagtcgtacgtcatggtcgtggacacggggtcctcgctcacctggctccagtgctccccctgcgtcgtgtcgtgccaccgcccagtccggcccggtgttcaaccccagggcgtcagctcctacgcctcccgtgtcctgctccgcgcagcagtggcaggaccttcacaacgccacgctaaaccccgcctgctgcttcaacctgcaacgtctggctctaccagggccagctaaa

SEQ ID NO: 89694 - protein, 214 aa, Zea mays
  misc_feature: Ceres CLONE 1577451
  misc_feature: SWISSPROT Homolog: EC 3.4.23.12 Nepenthesin
MALLRLLALISLLFAVATPVRDIAHDACSSEVKDFQHLNNSSGLHLTLHHPQSPCSPAPLPADLPFSAVLAHDGARIASLAARLAKTPSSRPTLLDESRAGSSSSSPDDESLASVPLGPGTSVGVGNYVTRMGLGTPAKSYVMVVDTGSSLTWLQCSPCVVSCHRPVRPGVQPQGVSSYASRVLLRAAVAGPSQRHAKPRLLLQPATSGSTRAS

SEQ ID NO: 89695 - DNA, 821 bp, Zea mays
  misc_feature: Ceres CLONE 1577453
  misc_feature: Encodes the peptide sequence at SEQ ID NO. 89696
  misc_feature (640)..(640): n is a, c, t, g, unknown, or other
ggagctcaccgcggtggcggccgctctagaactagtggatcccccgggctgcaggaattcgtctcacccctagaaaaaagccattgtacccttttgcacgcctccctatgttacttccttcctcccacactcctccgtctcctccatgcgggctgtataatactctgccaccgctgctgcggtacggtgctgctaccaaaccgcaggaaggaccgcaggaggcttggagcttgcctgccggggcccgagctgctgccggtgctcgaagcgatgaagctggtgacgggggtggatttggagacggaggtggagctgtcgccgatcgccaaggccgaggaagcggccgtgtttagcccctactccagcccgagcaccgccttattgctgcagaggagagtcgtgtcctggtccacggagaccgggtctccggcgacggtccgcgtgcgcctcggcgacagaagcttcgacctgcacaaggaccctctggtgtccaagtgcaagtatttcagcgaagcgtcgctccagcccggcggcgacgtcgtcgagctgccggccagctccccgggggtccgcgaggcgttcgagtcggtcgcgctcttctgctacggcgacgccgtggcgctggaccccttcaacgtcncggcggtgcggtgcgcggcggagctcctgggcgtgggcggcctcggcgcgcgctgcgacctgtacatcagccaggtggtgctgcagagctgggacgacgcgctcatcgtgctgcagcgctgcctgccccctgctcccgcccgcgaagagctcctcgtcgtcagccgctgcgtcgaagcgct

SEQ ID NO: 89696 - protein, 183 aa, Zea mays
  misc_feature: Ceres CLONE 1577453
  misc_feature (124)..(124): Xaa is any aa, unknown, or other
MKLVTGVDLETEVELSPIAKAEEAAVFSPYSSPSTALLLQRRVVSWSTETGSPATVRVRLGDRSFDLHKDPLVSKCKYFSEASLQPGGDVVELPASSPGVREAFESVALFCYGDAVALDPFNVXAVRCAAELLGVGGLGARCDLYISQVVLQSWDDALIVLQRCLPPAPAREELLVVSRCVEA

SEQ ID NO: 89697 - DNA, 768 bp, Zea mays
  misc_feature: Ceres CLONE 1577457
  misc_feature: Encodes the peptide sequence at SEQ ID NO. 89698
ggagctcaccgcggtggcggccgctctagaactagtggatcccccgggctgcaggaattcgtctcacccctagaaaaaatgattccaaatttctcctctccgcgacgggcgcccatggccatggcagacgaaacccttgcgccctcgtcgtcgtcggcaaagccctaaactttagtccacctccatttcggaaccttagccgggcgttcctgcgccgctgccatgggctgcagtcgccatgtccgttttgtctcctccggcgtcaagctaccgtccgcgtccgcgccatccccgttcccggcgcccgctcccgcgctcctctctgcggcgctcccgttcgcgcacatcggccgcgccatcgacgccgccgcgcgccgcctgggcgcatgcctgccccgcgtcccggttgcacgggccgacacggctccgcccccgccgcggaggcacgggaaggacggcggaggggccgaggagcgggtgctgatcagcgaggttgcggtgcggggaaaggacggggagccactggagcggcccgagctggaggccgaggccgcggcggcgctgcgcgcgtgccgccccaatgccgcgctcaccgtgcgggaggtgcaggaggacgtgcaccgcatcgtcgagagcggactcttccgatcgtgtatgcccgtcgctgtcgacacccgtgatggcattcgcctcgtcttcgaggtggagccgaaccaagacttccatgggctggtatgcgagggtgccaacttgctaccgtccaagttc

SEQ ID NO: 89698 - protein, 182 aa, Zea mays
  misc_feature: Ceres CLONE 1577457
MGCSRHVRFVSSGVKLPSASAPSPFPAPAPALLSAALPFAHIGRAIDAAARRLGACLPRVPVARADTAPPPPRRHGKDGGGAEERVLISEVAVRGKDGEPLERPELEAEAAAALRACRPNAALTVREVQEDVHRIVESGLFRSCMPVAVDTRDGIRLVFEVEPNQDFHGLVCEGANLLPSKF

SEQ ID NO: 89699 - DNA, 796 bp, Zea mays
  misc_feature: Ceres CLONE 1577458
  misc_feature: Encodes the peptide sequence at SEQ ID NO. 89700
ctccccgcggtggcggccgctctagaactagtggatcccccgggctgcaggaattcgtctcacccctagaaaaaagctggtaagcgtagtggaggaagagagggaagaagacgaagcgaagccaaagcaaggtctgagccgtagagcggtagaggtaggtgtccgggtgggaaacctctctcgcgcgtcaggcgtcacgtgagaactcccgatccaccgggacgacggattcccgccgctcccccgcgcgcggcttcttccggtgcggtccggcagccgacggcggaagctactggcccaagcaaagtgagtgaattgcgagtccaggcggcgatggcggggcgctgcgattgacgtgcgacgactatgggcatccaagggaacaaggcggcgacgcacgagcacgacttcctctcgttgtacgccgccgccgccgccgccgccaaagacgctcctctcctgctccacgactccaagacgccgcctccttctgcaggtaattttctcttgaagacgcacgacttcctgcagccgttcgatcagaagccaggagcgccgcctgagccgtcgccgctgcccgctccagccgcggagatcaggcacgggcagcatgtggcggtcgccaagcagcgcgcgctgccccttcccctggccgggcggcgtcgggcacttcaacatcagcccccgccccccgtgtcggttcgcgctgcccttcggcccgtcttcaaagtgggaacccccccccgtttcgtgcccttggggccaatctggcagcggaacccttcaagccgggggt

SEQ ID NO: 89700 - protein, 143 aa, Zea mays
  misc_feature: Ceres CLONE 1577458
MGIQGNKAATHEHDFLSLYAAAAAAAKDAPLLLHDSKTPPPSAGNFLLKTHDFLQPFDQKPGAPPEPSPLPAPAAEIRHGQHVAVAKQRALPLPLAGRRRALQHQPPPPVSVRAALRPVFKVGTPPRFVPLGPIWQRNPSSRG

SEQ ID NO: 89701 - DNA, 780 bp, Zea mays
  misc_feature: Ceres CLONE 1577460
  misc_feature: Encodes the peptide sequence at SEQ ID NO. 89702
ctggagctccccgcggtggcggccgctctagaactagtggatcccccgggctgcaggaattcgtctcacccctagaaaaagtgacccacccacccgcctcgcctccagtgccagcgacgacgcccatcttcgctctgtgcgctgcaccaccacctctccgaccccgtctacgtccgcaaccgtccgcctccgacttccccgtggcccagccggatccggagccgaactagaccttgttcacgaaggagagcccgaaccgcggcgggcgggagggctctttttagcttgccccgcctgaggccagccgccccatgggccagtcgcctgagcgcgctacgtatcagctcatcgaccggcgggaagggcttgggtaaatcattatcgaaagcatctcccttttacatgtaaccgtgcatacaatatctggtaagatgagttcactaaataaagttgtttcaaatagcggagatgcatgttcagtcttagctagtaaagtcacatcattaaatcccaatgcagcggagtttgtaccgtcatgtgttaaaccatcttttggaaatgggacagatcgagataagtcagatggcaagacgtcttcgggaggaacaattctagatagggctgagccatcgtagtctaatacctcagatgatgaagcacaccagttgtggcaaaaggcagcgtccggaagaaatttatgccagacttcacttcttttggaaaaaagttaaaaaaagggcttgtaaccgtcccttggccgggattatcccttgaaaatga

SEQ ID NO: 89702 - protein, 67 aa, Zea mays
  misc_feature: Ceres CLONE 1577460
  misc_feature (20)..(37): Pfam Name: PAM2 Pfam Description: Ataxin-2 C-terminal region
MSSLNKVVSNSGDACSVLASKVTSLNPNAAEFVPSCVKPSFGNGTDRDKSDGKTSSGGTILDRAEPS

SEQ ID NO: 89703 - DNA, 848 bp, Zea mays
  misc_feature: Ceres CLONE 1577461
  misc_feature: Encodes the peptide sequence at SEQ ID NO. 89704
  misc_feature (652)..(652): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
ctccccgcggtggcggccgctctagaactagtggatcccccgggctgcaggaattcgtctcacccctagaaaaagcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataaggcaatctgaaaacattggccgccaaacctccagagcgactcccgcgagccgtgaccaccatagctaaatcaacgcaccagaagctttcacggagctgtctcgtccacgagtgttccagctgactcctattccctgcgtcaatggcgagctctggcaatgaagggcgtgtggtggtggaccttggctccgcggcggagtcggtggctgctgacgaggaggcgcacgccacgcctctccacgagattgagtccctttgcatgcgctgcggcgagaacggcatcacgaggcttttgctgacgtgaccccttcggagtgtcatgctcatgcactgtggaagaacatctggaccagcgggagtcactcacatatggagatatgtcnaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 89704 - protein, 53 aa, Zea mays
  misc_feature: Ceres CLONE 1577461
MASSGNEGRVVVDLGSAAESVAADEEAHATPLHEIESLCMRCGENGITRLLLT

SEQ ID NO: 89705 - DNA, 765 bp, Zea mays
  misc_feature: Ceres CLONE 1577462
  misc_feature: Encodes the peptide sequence at SEQ ID NO. 89706
  misc_feature (504)..(504): n is a, c, t, g, unknown, or other
ctcaccgcggtggcggccgctctagaactagtggatcccccgggctgcaggaattcgtctcacccctagaaaaacggaaaagaaactagacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggagctgagtttgccaagaacaacaacctggaggccctgttccatgtggatgaccccgggccgaaggtccccatcaagaagggcaagttcctggacgtgaacgaggctctcgaggtggtccgttttgacatccagtactgcgactggagggcgcggcatgatcttctcancatcatggttctccacaacaagtgggtagaggtcctcaaccccctagcgagggagttcaagtcgatcgggaccttgaggaaagaagctgccgagctacagcaggagctgggcaaagctcacaatcaggttcatctctccgaaaacagaagtctcatcctgccctccaacaagctaaggcatatggaaaacccctgtgaaaaaaaaaggttggtggcccccggacgggaacccccttgtactttcccagggggcaaccccat

SEQ ID NO: 89706 - protein, 185 aa, Zea mays
  misc_feature: Ceres CLONE 1577462
  misc_feature: SWISSPROT Homolog: EC 1.13.12.14 Chlorophyllide-a oxygenase
  misc_feature (99)..(99): Xaa is any aa, unknown, or other
MNTVALLSLAPQLLIKPSLTCFSRKGVGRYGGIKVYAVLRDDGAEFAKNNNLEALFHVDDPGPKVPIKKGKFLDVNEALEVVRFDIQYCDWRARHDLLXIMVLHNKWVEVLNPLAREFKSIGTLRKEAAELQQELGKAHNQVHLSENRSLILPSNKLRHMENPCEKKRLVAPGREPPCTFPGGNP

SEQ ID NO: 89707 - DNA, 891 bp, Zea mays
  misc_feature: Ceres CLONE 1577464
  misc_feature: Encodes the peptide sequence at SEQ ID NO. 89708
  misc_feature (679)..(679): n is a, c, t, g, unknown, or other
  misc_feature (861)..(861): n is a, c, t, g, unknown, or other
acccgcggtggcggccgctctagaactagtggatcccccgggctgcaggaattcgtctcacccctagaaaaacagacaagaaacttgacgcatcgagtttctcattcactcccgattttccgtgttacctcgctaggattgcgctccccctgctcaaaacttctgccgcatcaaaaaaactagccgtctccgcgctggctttctccatgaacaaggagcctctgctgcccttaggtccgcagctgctcattaagccctccctcacctgtgtctccataaacggcgttggacgctatggatgaatcaaggtgtacgccgtgctcatagacaaccgagctgattttgccgagaacaacaacctggaggccctgttccatgtggatgagccctcggtcgagggtccccatcaagaagggcaagttcgtagtacgtcaaactaggctctgcaaggtgatccggtttttaactccaaataaccggctactggaaggggggggggcattgatacttcgaaaccaatcatggggtcaccccataaacagggtgggggaaaaagggggcttaaaaacccccttaggagggggggagcttccaaaggggcaataaggggaaaccttgggggggaaaaaaaaactgtggcccaagctcacacaaatagggaagttgggcaaaaaaaacnttaaaaatttgagggttccatttctatggggaaaaacgcggaattcctctttcttggcgctctccgaaaaaattttagccccaaaatttggagaaaaactttggtgtaaaaaaaacaggcggggtttggccaaacccggaaggggagaccccctcttgtaacaatgcccccgggggggcaancaccacttttcgtttgtggtgttcccaaag

SEQ ID NO: 89708 - protein, 31 aa, Zea mays
  misc_feature: Ceres CLONE 1577464
MNKEPLLPLGPQLLIKPSLTCVSINGVGRYG

SEQ ID NO: 89709 - DNA, 828 bp, Zea mays
  misc_feature: Ceres CLONE 1577465
  misc_feature: Encodes the peptide sequence at SEQ ID NO. 89710
  misc_feature (718)..(718): n is a, c, t, g, unknown, or other
  misc_feature (719)..(719): n is a, c, t, g, unknown, or other
ctccccgcggtggcggccgctctagaactagtggatcccccgggctgcaggaattcgtctcacccctagatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggtctgagtttttttattgtcgtcgttgatgccaaaggaacactgtacctagaggacagtcctatgcctcggagcttggaataatgatgatggagggagcggaaggatgcctgccatttgttggagcgtgcgtggtagtatttctaggcctgtaataaacaatgcctttttccatttacgttgttggttttatccggtgaccctcacacgattcatcaaggtggtgagcctggctattaaatcgggtgctgttttttttgggtaaacattggcaatggccttactgtcttgcagcagtgcttcgttcgtttgctggattgtgggtttaagatgctgcattttggctcttttgttgatacattttcccattggcttttgtttgtgatacatacatagcatttatatattaagctccgnncgaaaaggcatttatttactgaccttccgaactgggggcagtaaaggggcttcccggtttgctgcccaccgggccttttgggatcttttaccttgaaaaacaatctccc

SEQ ID NO: 89710 - protein, 95 aa, Zea mays
  misc_feature: Ceres CLONE 1577465
  misc_feature: SWISSPROT Homolog: EC 2.2.1.1 Transketolase
PRGGGRSRTSGSPGLQEFVSPLDEQSDEYKESVLPAAVTARISIEAGSTLGWQKYVGAQGKAIGIDKFGASAPAGTIYKEYGITVESIIAAAKSF

SEQ ID NO: 89711 - DNA, 856 bp, Zea mays
  misc_feature: Ceres CLONE 1577470
  misc_feature: Encodes the peptide sequence at SEQ ID NO. 89712
  misc_feature (350)..(350): n is a, c, t, g, unknown, or other
  misc_feature (387)..(387): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (805)..(805): n is a, c, t, g, unknown, or other
  misc_feature (806)..(806): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (817)..(817): n is a, c, t, g, unknown, or other
  misc_feature (820)..(820): n is a, c, t, g, unknown, or other
  misc_feature (822)..(822): n is a, c, t, g, unknown, or other
  misc_feature (825)..(825): n is a, c, t, g, unknown, or other
  misc_feature (841)..(841): n is a, c, t, g, unknown, or other
  misc_feature (842)..(842): n is a, c, t, g, unknown, or other
  misc_feature (845)..(845): n is a, c, t, g, unknown, or other
tccccgcggtggcggccgctctagaactagtggatcccccgggctgcaggaattcgtctcacccctagaaaaaaaaaaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctanctgagacaaggcattgggtgttggtggcttccagaangatttatgggtggccgccaagagtaatggctcacgcccaccctcacttctgcaggagcaggtgttgccatttcacgcaaacatcctccaacaaactgcaggaagatgggcattctttgatgtcgatccccaagggtggaacgggccatccacctccccaggggaaggcctgatcctgaacccagtgggctggaaaggggtccctgtttaacccttaaacaaccccccaatttggggttccaaaaaagccaaggttaaatttgtgaaaaagggcccccctttttttgccacctggaaataaagatttttggggttaaaaaaaacccagggcttcctccagttggggtcccacagggtttttccccccagaaacccctttttttaaaaaacccttttggtgggtggtaaaaaannnnnannannnnnnnaanaananaanaaaaaaaaaaaaaaannccncaacggacgga

SEQ ID NO: 89712 - protein, 88 aa, Zea mays
  misc_feature: Ceres CLONE 1577470
  misc_feature (7)..(88): Pfam Name: Ribosomal_S19e Pfam Description: Ribosomal protein S19e
  misc_feature (68)..(68): Xaa is any aa, unknown, or other
  misc_feature (81)..(81): Xaa is any aa, unknown, or other
MAASTARTVKDVNPHEFVKAYSAHLKRSGKMELPEWVDIVKTARFKELPPYDPDWYYIRAASVARKIXLRQGIGCWWLPEXFMGGRQE

SEQ ID NO: 89713 - DNA, 862 bp, Zea mays
  misc_feature: Ceres CLONE 1577474
  misc_feature: Encodes the peptide sequence at SEQ ID NO. 89714
ctggagctccccgcggtggcggccgctctagaactagtggatcccccgggctgcaggaattcgtctcacccctagaaaaaccttccctccgcctccgcctccgcccacgcccccgcccacgcccactcctcgctgccaacactcctgtcacctcttcccgcgccgacgcaaccgccatggaccccgtcgccacatgggggctaaccccgctcgcgggcgccgacccggagatctacgacctcctggagcgctataagcggcgccagcgtctcggcatctagctcatcgcctccgagaacttcgactccttctccctcatggaggaactcggctccgcgctcactaacaagtactccgagggcatgcccggcgcccgctactacggcggcaacgacgtcatcaacgagatcgagaacctctgcgggtcacgcgcgctcgctgccttacaacttgacgccgcgtcctggggcgtcaacgtgcagtcctactcgggctcccgccgcctacttcgccgcgtacaccgcgctgctcaacgcgcacgatcggatcatggggctcgaccttccctcgtgcggacatctcactcaagggtactacatcggcggcgggtatgaagatctccgccacctcgatctacattaagtaccctgcctgacaaagtgagcgcggccaacggggtacatcggactacgacaagctccgaggagaaagaacttggacttgcgaccacaaattatttctctggcggggggaggggcctaacccgaagggaatggggattttcgccaaggtttcaggggccgtcccaccggacaaagttcgaggggcaccttgggggcttttggcccgatgggggcgccca

SEQ ID NO: 89714 - protein, 98 aa, Zea mays
  misc_feature: Ceres CLONE 1577474
  misc_feature: SWISSPROT Homolog: EC 2.1.2.1 Glycine hydroxymethyltransferase
MEELGSALTNKYSEGMPGARYYGGNDVINEIENLCGSRALAALQLDAASWGVNVQSYSGSRRLLRRVHRAAQRARSDHGARPSLVRTSHSRVLHRRRV

SEQ ID NO: 89715 - DNA, 783 bp, Zea mays
  misc_feature: Ceres CLONE 1577477
  misc_feature: Encodes the peptide sequence at SEQ ID NO. 89716
  misc_feature (588)..(588): n is a, c, t, g, unknown, or other
  misc_feature (727)..(727): n is a, c, t, g, unknown, or other
ctccccgcggtggcggccgctctagaactagtggatcccccgggctgcaggaattcgtctcacccctagaaaaacgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccaccntctgtggtccttgctcaggggctgattgctgagggtgttaaggtcgtagcagctggtgctaatcctgttcagattactcgtggtattgagaaacagctaaagcactagttgaagaactacggaagtcgtctaaggaggntgaagatagtgagcttgcagattgtgctgcagttagtgctggcaaacactatgaaa

SEQ ID NO: 89716 - protein, 135 aa, Zea mays
  misc_feature: Ceres CLONE 1577477
  misc_feature (126)..(126): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTXCGPCSGADC

SEQ ID NO: 89717 - DNA, 791 bp, Zea mays
  misc_feature: Ceres CLONE 1577478
  misc_feature: Encodes the peptide sequence at SEQ ID NO. 89718
ctccccgcggtggcggccgctctagaactagtggatcccccgggctgcaggaattcgtctcacccctagaaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgagggacctcgcgaggggcggggcgggcagggagaagaagctaagaaaagcgagggaaggaccacggggagggggagggacactgggattggtgagggataggcggggatctagggagggaagggtccctccctcgggaatcgcgattaccaggattttgggggaaagggggaggaggttccgaaaagccgcggtgtttccgtatgactgggggggtgggaattataggtggcgagggggtgaagtaaaattgtttcccaataaagaggtcgtctcgcaggaaatataaaataa

SEQ ID NO: 89718 - protein, 201 aa, Zea mays
  misc_feature: Ceres CLONE 1577478
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSAEARKRKGSSSLRDLARGGAGREKKLRKAREGPRGGGGTLGLVRDRRGSREGRVPPSGIAITRILGERGRRFRKAAVFPYDWGGGNYRWRGGEVKLFPNKEVVSQEI

SEQ ID NO: 89719 - DNA, 740 bp, Zea mays
  misc_feature: Ceres CLONE 1577485
  misc_feature: Encodes the peptide sequence at SEQ ID NO. 89720
  misc_feature (700)..(700): n is a, c, t, g, unknown, or other
ctccccgcggtggcggccgctctagaactagtggatcccccgggctgcaggaattcgtctcacccctagaaaaatgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccaggggcaacgccactgtccctgctatggagatgaccaagtggtttgacaccaactaccactttattgtcccggaattgggcccaaacaccaagttctcctatgcttctcacaaggctgttaacgaatataaggaggctaaggcgctcggtgttgataccgtgccagtacttgttggaccagtctcgtacctgttgctctcaagcctgcccagggtgtggagaagggatttccctctcttttcctttctagcagcatcccttcagtcntacaggaggtcattgctgagttgaaggcagctggggcttc

SEQ ID NO: 89720 - protein, 194 aa, Zea mays
  misc_feature: Ceres CLONE 1577485
  misc_feature (2)..(194): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLVGPVSYLLLSSLPRVWRRDFPLFSFLAASLQSYRRSLLS

SEQ ID NO: 89721 - DNA, 773 bp, Zea mays
  misc_feature: Ceres CLONE 1577487
  misc_feature: Encodes the peptide sequence at SEQ ID NO. 89722
  misc_feature (539)..(539): n is a, c, t, g, unknown, or other
ctccccgcggtggcggccgctctagaactagtggatcccccgggctgcaggaattcgtctcacccctagaaaaaatgcaaaagctgctgctgcgcgatggacacagctaacacaagcaagcaagacagtcaatagaatagctagcagcatataccacgataaaaacaacacacacacacgctgcgctgacaatctgacctcaaggcaacgcctctctagctcctgctagctcgcaccgaccactgctgaccatggctgctcaagtgcatcacgcactatacgagctgcggcacgaagcagcaggagctcatccagcgctgctgatcggaatccccttctcccttgctgctactgacgactcctgctccaataccgcgcggcatcagcgtctgcgtctgcatccgcagacaagaaccacagatcggctgcagtggaagccactctacacgacgatctctggagactgctgccgtatccagctatgaagctcccatcatcaggaacctgcccctgatgggggaatcccgatgagtgactgnccacggttcccaaaagttacggcccggaaaaaaaggttgtgagccttagagacttgcggaccgtgttgggccgggggacccagctaccaagggcggggaccggaaattaaaaaaggaatttcccccccccccggtcccgggggggtgggaaaaaaaatgggggggccccccgaaagggggtttttttctcaaggggaaaaaaaaaaaaaagggggggaatttgtttcttttctc

SEQ ID NO: 89722 - protein, 77 aa, Zea mays
  misc_feature: Ceres CLONE 1577487
MAAQVHHALYELRHEAAGAHPALLIGIPFSLAATDDSCSNTARHQRLRLHPQTRTTDRLQWKPLYTTISGDCCRIQL

SEQ ID NO: 89723 - DNA, 756 bp, Zea mays
  misc_feature: Ceres CLONE 1577489
  misc_feature: Encodes the peptide sequence at SEQ ID NO. 89724
ctccccgcggtggcggccgctctagaactagtggatcccccgggctgcaggaattcgtctcacccctagaaaaactgccaaaagatcctctcggatgcccccgcccccgcccacccatttcgccagtcgccatcgagctctcgcttccgcctcccgctgccgctctatcaccccggtgctgagccctaggatgtgactggcggacgtctctatggccgagccgtaggtggaggcggcacctcggcgccgtgggagatggaggacgatgacaccgagggtgtaggcgagagcacctgtccccccgccgccgaccgaggaggctcctcctcggccggcggcggcggcggcgactcgcacagttacactgacatagagaaggaggtcttcgaccgtctcatggagaagagaatcccggaggtcgtcgcggacccggtggccttccgcgaagagctccgccgccacttcgagcgcctgccgctgagctacgccgtcgatgtgaacgtcgacaaggcggaggacgtgctgctgcaccggaggattctcaacgagtgcgctcaccctggatatcgccccatcttccatgtgggcttcctgaactgcatcccgccctcggtggatccacagtataacactcagtccatctctacgagcgaaaacggtaatttgtggggggtctcaggtatccacttttgagaaaatttgagccatgcgaaggggatcgaggacctcagtttaactgggacaaaaaagttgtgg

SEQ ID NO: 89724 - protein, 145 aa, Zea mays
  misc_feature: Ceres CLONE 1577489
MEDDDTEGVGESTCPPAADRGGSSSAGGGGGDSHSYTDIEKEVFDRLMEKRIPEVVADPVAFREELRRHFERLPLSYAVDVNVDKAEDVLLHRRILNECAHPGYRPIFHVGFLNCIPPSVDPQYNTQSISTSENGNLWGVSGIHF

SEQ ID NO: 89725 - DNA, 748 bp, Zea mays
  misc_feature: Ceres CLONE 1577491
  misc_feature: Encodes the peptide sequence at SEQ ID NO. 89726
  misc_feature (551)..(551): n is a, c, t, g, unknown, or other
  misc_feature (700)..(700): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (717)..(717): n is a, c, t, g, unknown, or other
ctggagctcaccgcggtggcggccgctctagaactagtggatcccccgggctgcaggaattcgtctcacccctagaaaaacccaccaggccagaggccaccgcttgccctttcttccctgccggctgccgcgctcctaataattgcatcgccgccccatgtccgccctgcttattcttgtggctagcctcgctgcttagtgcttatatcaccattcaccagctagcttctcaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcngcttccgcttctcccgcctcatcgtcttcctcctcttcctgcccaccccgcccatcaaccccgccgcgcacctcgtctcgctcgtgtcctcgcccgccgtggcgctcgcggggggccaacgccacggccacgaataccaagaccaccanccnnncacacaccggtnaccaaccaccaccaaccaccggtggccgccc

SEQ ID NO: 89726 - protein, 116 aa, Zea mays
  misc_feature: Ceres CLONE 1577491
  misc_feature (51)..(51): Xaa is any aa, unknown, or other
  misc_feature (100)..(100): Xaa is any aa, unknown, or other
  misc_feature (102)..(102): Xaa is any aa, unknown, or other
  misc_feature (106)..(106): Xaa is any aa, unknown, or other
MKLPLLRPLWPGLGPAAAGPPDAAPEPAKPSLPATWLLLHALFCATSMAVXFRFSRLIVFLLFLPTPPINPAAHLVSLVSSPAVALAGGQRHGHEYQDHXPXTHRXPTTTNHRWPP

SEQ ID NO: 89727 - DNA, 797 bp, Zea mays
  misc_feature: Ceres CLONE 1577492
  misc_feature: Encodes the peptide sequence at SEQ ID NO. 89728
ctccccgcggtggcggccgctctagaactagtggatcccccgggctgcaggaattcgtctcacccctagaaaaaacatccttattggaagggcagctaataaggtataaggggcgacgaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgcctctgccgccgtcgtcgtcgccctccgccgccgccatcccggtggtggacctctcggtgacgcgccgcgaggacctagtcgagcaggtgaggcacgcggccgggacggtgggcttcttctggctggtgaaccacggcgtggcggaggagctgatgggcggcatgctccgcggggtgcgccagttcaacgagggccccccgtggaaggcgatgcaggcgctctactcgagggacctcgctcgcaacctgcgcttcgccctcaacttcgacctcttcaaagctgctgcggccgactggcgcgacacgctcttctgcgaggtggctccgaacccgccgccgcgggaagagctgccggagccactcaggaacgtgatgctggagtacgggcgcgcggtgacgaagctgggggcggttccctgttccagctgctgtcccaaatccctcggcatgcccagcgaccacctgttacaaaaaggagtgcccccagaaccttgga

SEQ ID NO: 89728 - protein, 225 aa, Zea mays
  misc_feature: Ceres CLONE 1577492
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSSSPSAAAIPVVDLSVTRREDLVEQVRHAAGTVGFFWLVNHGVAEELMGGMLRGVRQFNEGPPWKAMQALYSRDLARNLRFALNFDLFKAAAADWRDTLFCEVAPNPPPREELPEPLRNVMLEYGRAVTKLGAVPCSSCCPKSLGMPSDHLLQKGVPPEPW

SEQ ID NO: 89729 - DNA, 1167 bp, Zea mays
  misc_feature: Ceres CLONE 1577494
  misc_feature (75)..(75): n is a, c, t, g, unknown, or other
  misc_feature (76)..(76): n is a, c, t, g, unknown, or other
  misc_feature (898)..(898): n is a, c, t, g, unknown, or other
  misc_feature (1167)..(1167): n is a, c, t, g, unknown, or other
tggtgggggggggggggtatttttttttttttttattttataatatcaagtggtatgggttttttgtgggggggnnttcaaaactggagctcacctcggtggcggccgctctatactagtggatcccccgggctgtacgaattcggctcacccctacaaaatacgagggccccgcgccggggcctgccttggtggggcgcagcttggaaggcgtgagcttcgcgaccgcgccggccgacgaagaggcgtgagagcgcgctacaattataggagggcgtctcgcccgcccgatggccactgatgacgcggcgcggagcaccgcacggatggatctgaacctctacctcggtctctccagggccccgggcgccccaagccccgatctcggctccgacctcgcgctcggaaccccgatgctttcttcatcagctacatcgtcctcagacgcctccttggacacgccgcctcttggagacagatcccaccccaccccacactactcggctgtcccccgccctaaattggttgcgcccagccccatacccccgggtgcaaacgacccccctaacagtcccggtttcgctgcccggaagggagggcaccccccccccccttatggttggccattcccgcccaaaccacacctggaccgggggttttcccacggggggggccctccttaaccccataggaggaccttcctcccattctcaattggggaaaccacctttcgtggagagtcctcttggtgggggatatgtgggttttctccaccggaaacacgcacctcgcccagaaaaacacttctcgtgggagtacccacagaggagctccccgacagaaagcatgcttttttgggagtaacacccggggaggcccgctttttccccgtctcacnggatcctcgtaaaccgcagcccaatgtcttttttccatgtaacgccctttttcgacacacgccctgagagatatcttctcgccgcgctcctgaagagaggatccttataccgcacgcctcgctttttgttaatatgtaaacccactttggggcctccgcagatatcctattgggggtaacacactggcggggggccacaaagaaaaggggttttctcctcctttccactagaacctttgcgctaactgttttaaaaacacatagaaaan

SEQ ID NO: 89730 - DNA, 833 bp, Zea mays
  misc_feature: Ceres CLONE 1577499
  misc_feature: Encodes the peptide sequence at SEQ ID NO. 89731
ctccccgcggtggcggccgctctagaactagtggatcccccgggctgcaggaattcgtctcacccctagaaaaaacgccccgcccgtgatgcccgctgccgcgcgcatcttcctccccgcaccccgcatgccccgcgccgcgaactgctcctcccgcacgccccgcccgtgatgcccgccgccgcgcgcgtcttcctccttcctccccgctagctccgcgcttccttcgcccaccaacgcccgcacccgccaagtcccccaccaacgccactatagcccgcacctctctagactagggcacccaaacccgagccgtcgtccccattgtgcctctcgacgcgcagccaaacccaaacccttcctcccgacgggcgacggcgatggccgccgcgacagagaagacggctgaggacatccgccgcgagctccaggagctccagtgccagcaccgcgagatcaccgagcgcctgcgcgacccccgtggccttcgtcgcggcacccccggccctggtcctggacctgggcccccccccccgcccactccgcggcttcgtgagatccatgagcttctcacatgcccccactcattcctcattttgtttaatcttaatctatttgtgtgcgtgcaagacatttttttcaatgtttatgatgtagcatgtggggtgtggaagtggcgggattagcctccgcagaagcgttggctgctatcgggcgtagtttaggttgatggcgctgaaaaatatgaatatgacacaaaggatgccgatgggggaggggccaagaggcggtttcatgtgccactgaaagcagtggataaaagggattttacc

SEQ ID NO: 89731 - protein, 101 aa, Zea mays
  misc_feature: Ceres CLONE 1577499
MAAATEKTAEDIRRELQELQCQHREITERLRDPRGLRRGTPGPGPGPGPPPPPTPRLREIHELLTCPHSFLILFNLNLFVCVQDIFFNVYDVACGVWKWRD

SEQ ID NO: 89732 - DNA, 749 bp, Zea mays
  misc_feature: Ceres CLONE 1577502
  misc_feature: Encodes the peptide sequence at SEQ ID NO. 89733
  misc_feature (245)..(245): n is a, c, t, g, unknown, or other
acccgcggtggcggccgctctagaactagtggatcccccgggctgcaggaattcgtctcacccctagaagaacttctgtccagtcctctgtcctcacctaccttatccccaaaaccctatcagcccaaaaccgaacccacacctctgcccttcccatggcggccacgctattctccacctccctcttgccccagttcctctccctctccgctaagcccgccgccgccgccgccgccccgtccgcncgccgccttcccatcggggatgccgcagctccacgcgctgtccgccgcggcggtgggctttaggccgctcgagcccgtgcgagcagccgcgaccgcggccgtgacggaggagctcgaggcggaggggcgttcgggcggggacgagttttcagatgatctcagggtcttcgtcggtaaccttccgttcagcgtcgacagcgcccagctcgcgggacttttcgagcaggccggctccgtcgagatggtcgaggttatctatgacaaattgacgggaagaagccgtggattcgggtttgtgaccatgtcttcggtcgaagaaagttgaagtggctggtgaccaattaaatggctatggccctaatggaaaaaattttagggggaaaccttgggccccccccccccccaaaaatgggggattccccggttccccgcaaaaaaaccggggggggaagccccaaaagggggcctaaaggggggggaaacccctttcccgggggggaattg

SEQ ID NO: 89733 - protein, 101 aa, Zea mays
  misc_feature: Ceres CLONE 1577502
  misc_feature (49)..(102): Pfam Name: RRM_1 Pfam Description: RNA recognition motif. (a.k.a. RRM, RBD, or RNP domain)
MPQLHALSAAAVGFRPLEPVRAAATAAVTEELEAEGRSGGDEFSDDLRVFVGNLPFSVDSAQLAGLFEQAGSVEMVEVIYDKLTGRSRGFGFVTMSSVEES

SEQ ID NO: 89734 - DNA, 805 bp, Zea mays
  misc_feature: Ceres CLONE 1577503
  misc_feature: Encodes the peptide sequence at SEQ ID NO. 89735
ctggagctcaccgcggtggcggccgctctagaactagtggatcccccgggctgcaggaattcgtctcacccctagaaaaaccctccctcatagcagtcggctgccgtggtccggtgacctccccacgatgcctcccgggaagagatccacacagccctcacggaattccgaagaagaccctcttactgaatacgagaaaatgagggctgtgaatatgatgaagaacaatcaattgtttcaacggctaggccttggacaattaaaaacaatgatcaccgcaacaactacaaacaacaatcaaggcggtcctcaggaatcaggttctttatatgatggtgagaacgttgaggattctggtgaagaggatgttggcatggaattccaagctcgtaagggtgtccctacccacatctccaatgatggtgaacatatgtcaacaaaagtaacaagaggaaataaaagaattatggcacctgtgcaggaacggccagttagagtcactagacaaagagttgctgaagtaaaccaaatgtctacccatagcctaaatgtttctacacaacccagttcaagtgccgccacaaaccatgatttgacccacaaccttattgttcctacacatcctagttccaatactgccacaaaccatgagcccatccaagacatggatactattgcacaacctactttccagatacagggagggtgattaccacactggggaatcaagaaatcataccaaaggagaaaaagtatggggcagggcaacttgaaatcgttaagcagaaggactggggaatcaatt

SEQ ID NO: 89735 - protein, 169 aa, Zea mays
  misc_feature: Ceres CLONE 1577503
MRAVNMMKNNQLFQRLGLGQLKTMITATTTNNNQGGPQESGSLYDGENVEDSGEEDVGMEFQARKGVPTHISNDGEHMSTKVTRGNKRIMAPVQERPVRVTRQRVAEVNQMSTHSLNVSTQPSSSAATNHDLTHNLIVPTHPSSNTATNHEPIQDMDTIAQPTFQIQGG

SEQ ID NO: 89736 - DNA, 804 bp, Zea mays
  misc_feature: Ceres CLONE 1577505
  misc_feature (311)..(311): n is a, c, t, g, unknown, or other
  misc_feature (330)..(330): n is a, c, t, g, unknown, or other
ctggagctccccgcggtggcggccgctctagaactagtggatcccccgggctgcaggaattcgtctcacccctagaaaaagaaaggctcacaatacccacctccatttagctactactactccctcgctgtcttccgcaaccaacaaatcgacctagctaggcacaagagcgctagacgccgcagcgcagcacgcaccacccaccgagtggcggcggaggcagggcaatccgcagggagcagaggccgcgcgcgcaggcatgggcgcgccggtgcgcggcgccctcgccttgttcctcctgctcctgggangggcagggagcggcgcccnaagagacggcgccgcaggaacccacattgccagccaccggctccggcgctaccggcgcgccggcggtcggggtcaactccaactccgtgctggtggcgctgctggattcgcactacacggagctggcggagctggtggagaaggcgctgctcctgcagacgctggaggacgccgtctggaagcacaacgtctccatcttcgcgccgcagaacgaggcgctggagcgggacctgaacccggagttcaagcgcttgctgctggagcacgcaacctcaagtcgctgcaggcgctgctgctctacaggtccctcccctacgcctgccctccgactcctggaccccgggcgtccaacccacgctgtcacgccaagaagtcaagctccgggcccgaatgggcgtaggccagccgccctgagcgcccggacgcatggtcaggcccaaacgggtcatcacgggtaccaggggcccctcgtcc

SEQ ID NO: 89737 - DNA, 742 bp, Zea mays
  misc_feature: Ceres CLONE 1577507
  misc_feature: Encodes the peptide sequence at SEQ ID NO. 89738
ctcaccgcggtggcggccgctctagaactagtggatcccccgggctgcaggaattcgtctcacccctagaaaaactgccccctctccctggctcctgtgctccccatttccagttttccacccgacgagaggcaaaagcctcgcgccccacgccggtccggcggcgacccccgccgtttcccgcagcgaccaagacgcgggctgtggtcgcctccgccccgtgcctacccggccgcgggcgtagcagcctcctggaccgcagcgccctcccccctcctttctcccgagcgacttctgatccagccgcgtcgcaacaactggtcgttcgagtctgatctccgccaccgcggcggaacgaggcgtctccggtccccgaggcgattcggtgaattcgaagctcgtacgacgggatcctgttgagttttgacaattcggggctacgggtacgagaccaatggtaaccaccaggaagtggaagatgagtacggagatgagtactatgatcaagatgagtatgatgaggaaggttcgggtgctggggatgagtattttgaggaggaagagcctacagagggacaaaaggagatcctagaattgagagaacgattaaaagagcagattaggcgaaaggcataggctgctgcttcctgcacagctggcagatcgtcttctttacaaatacctcaagccagggacaaatttggctctttctttgggccatccaagccggtgatttctcgtc

SEQ ID NO: 89738 - protein, 45 aa, Zea mays
  misc_feature: Ceres CLONE 1577507
MVTTRKWKMSTEMSTMIKMSMMRKVRVLGMSILRRKSLQRDKRRS

SEQ ID NO: 89739 - DNA, 788 bp, Zea mays
  misc_feature: Ceres CLONE 1577508
  misc_feature: Encodes the peptide sequence at SEQ ID NO. 89740
ctcaccgcggtggcggccgctctagaactagtggatcccccgggctgcaggaattcgtctcacccctagaaaaagccgccccccggacgcaaccgcgtccgaccaccgccgccggaaccctacgcccccgcctcgccgcgccatggcggatccgccgcccgtggctgcctccgccttgccggcgcagcccgaccaggtcgccgcctccgtgtccaccccgcagaaccccaaccctaaccccctcctctccccccaaatccccccgtccccgaccgtctccgacctctccgcgcacatctcgtccccgtagcagctcgacccggtggctgcggcagctgccgcttcgggcggcgggggatccatggattaccccccgcgcccgccgcagctgcaggcgccttcgcccacgcaggcggggcccggcgccgccgggtttggccagatcccccgctcggggtcgggctcacgcctcttcacggccaggcagcttcagcagtacgcggctaggatgtacggcgggcagatgagcttctcgggtggcggaagtctcgtgggccagcagcagcagctgggggggcgcgcccccctgcttgggcaaggccagctggggaagctgcaagggccagggtaaaccgggatcttgccggacattttggggccttcattcccccaaaaaaggcgccaaggtagggcaaaaaggggcttgggccccaagggacccccattggaaaaaatggctaaaaaaaggtcccaagggccctttcaaggggaagcgcgcccccttgggg

SEQ ID NO: 89740 - protein, 89 aa, Zea mays
  misc_feature: Ceres CLONE 1577508
MDYPPRPPQLQAPSPTQAGPGAAGFGQIPRSGSGSRLFTARQLQQYAARMYGGQMSFSGGGSLVGQQQQLGGRAPLLGQGQLGKLQGPG

SEQ ID NO: 89741 - DNA, 839 bp, Zea mays
  misc_feature: Ceres CLONE 1577509
  misc_feature: Encodes the peptide sequence at SEQ ID NO. 89742
ctccccgcggtggcggccgctctagaactagtggatcccccgggctgcaggaattcgtctcacccctagaaaaaccctcacctctgactaccaccaccactgccccggatccataccagctgcagcagcagcgcgcgcgagctagcttcagtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaaggtgtggggggaggccacctacgacctcgccaccgtgctcgacttcctcgccgtcctcacgttcaccatctccgtctacttcatgtccaggcccaagccccgtggaactcattcaacttcgcatggctaaaagccgggccgacaaagttaaagggtcccaaggggggaattcattcaacctggggcaacaggtccggcaaagttcccaataaggacagccctgggcgtttccaagtcgggggccggggggggccaaaaatcggggcattcgaggaaaaaagatcggaaaattgacccaacgctttggattgtttctataacccccaacttccaaggtggtgggcgccccctttgtaaggggaaggcgcccgggcgcccaaaagggctg

SEQ ID NO: 89742 - protein, 186 aa, Zea mays
  misc_feature: Ceres CLONE 1577509
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKGVGGGHLRPRHRARLPRRPHVHHLRLLHVQAQAPWNSFNFAWLKAGPTKLKGPKGGIHSTWGNRSGKVPNKDSPGRFQVGGRGGPKIGAFEEKRSEN

SEQ ID NO: 89743 - DNA, 801 bp, Zea mays
  misc_feature: Ceres CLONE 1577513
  misc_feature: Encodes the peptide sequence at SEQ ID NO. 89744
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (521)..(521): n is a, c, t, g, unknown, or other
  misc_feature (530)..(530): n is a, c, t, g, unknown, or other
ctccccgcggtggcggccgctctagaactagtggatcccccgggctgcaggaattcgtctcacccctagaaaaatttctcctctcctctcccctcgctagttcgtcgcgtcctcctcagatcaacaaaccgtgtcctgctgctgcctctggaaaccaccgggggatcgccccgcccttttcttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcagtcccccgttccggtgctggaggtgcagtaccaccggcgcgcgacgaccaagggggttgacgacgtcgtcgggatgtccgcgcccgcccccgcggaagttgggtgggggtttttgggggggtttaaaaannnnagnnnaaagggtntaaggtttnaaaagaaaggttggccatggtttggggggtttgaagaaaggccggttggtgggaaaaaaggtgttatgcacttggtcatgaaaaactacacgtattctgccactacgggccgacctcagggaaaccgtacaacgatggtcgtgaccctcggaacgggctcatgaatgggaccaagccccgtcttaaaattaggtagaagcacttaggcgaaacctcattaggcctcaaaaggttttgggtaaaggaacatgtttcaatagcccagggtttt

SEQ ID NO: 89744 - protein, 115 aa, Zea mays
  misc_feature: Ceres CLONE 1577513
  misc_feature (53)..(53): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (59)..(59): Xaa is any aa, unknown, or other
  misc_feature (62)..(62): Xaa is any aa, unknown, or other
MVAEAEVMHQSPVPVLEVQYHRRATTKGVDDVVGMSAPAPAEVGWGFLGGFKXXXXKGXRFXKKGWPWFGGFEERPVGGKKGVMHLVMKNYTYSATTGRPQGNRTTMVVTLGTGS

SEQ ID NO: 89745 - DNA, 844 bp, Zea mays
  misc_feature: Ceres CLONE 1577517
  misc_feature: Encodes the peptide sequence at SEQ ID NO. 89746
  misc_feature (767)..(767): n is a, c, t, g, unknown, or other
  misc_feature (787)..(787): n is a, c, t, g, unknown, or other
  misc_feature (824)..(824): n is a, c, t, g, unknown, or other
cggccgctctagaactagtggatcccccgggctgcaggaattcgtctcacccctagaaaaaacgcatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagacgagctgcagagagaaaggagaagccgccatgaagtagcagcagctgcctcctagtcgtccccgttaaatccctgctcgccaagccacgactacgagcaccagccgtccagccccggtttttctcctcccgcccccgttccccgtcccgactcccgacccaacccatatcagagattccttccgttggtggcgctggcgtccgcgctggcgttcccgtgagtcggcccgcgcgcgaaagcggccgtgaccgaccgtccggagcttcatgcgccaggggcggcggctccaccccgtcgtttgatgagcaacgcatgcggcgggcgccctttgatccaagcacccagacagctttaaagcaccgccgcgtcgttggaagcggccacaacggcctcctccgaagtacaagggcccagcgcccgcgggccaaacaaattcgccccaggaaagcccggcataccgggcggcccggccatacatgggaaaggccaataaggggccgggcggnccggccggcccgggacaaangggaattttaaggcgcccgggccagggggaccccggntcaccccctccccgggagac

SEQ ID NO: 89746 - protein, 35 aa, Zea mays
  misc_feature: Ceres CLONE 1577517
  misc_feature (17)..(17): Xaa is any aa, unknown, or other
MGKANKGPGGPAGPGQXGILRRPGQGDPGSPPPRE

SEQ ID NO: 89747 - DNA, 992 bp, Zea mays
  misc_feature: Ceres CLONE 1577520
  misc_feature (1)..(1): n is a, c, t, g, unknown, or other
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
  misc_feature (44)..(44): n is a, c, t, g, unknown, or other
  misc_feature (72)..(72): n is a, c, t, g, unknown, or other
natttaatggggggggggagatactcaggannggggggngctcnaaccatttagggggtggggggggggggnccaaaactggactcgggggggaggcggccgctttccaacagtggatcccccgggctgcttgaattcgtctcacccctagaaaaagaagacgtcgatgcataacctcctcgtgcgttgtttgtctctctacttctctagtctagcccctctgtcgctctcagacgacgggtgcgccgccgccgccgccctaagccaggtgctgactgctgaggctttctttggtctcttcgccggcgacgacacccgccagtatccacggtgtcattgcaagacaagatggtttccttcgagatgaatgacctcaagagtatggacttgtcaccactctttttttaattgtcttcccaatttttgttccatttgtttctgataggagcatagatagtttgtgctaggcatgaatgtgtattgatttgcttgacgtcctttgtttctccctcataattcagaactttacaagctagcatgtttgcaaattgtcttgtgatgaatgggagaaaggcacccttcagggatgctactttgttttggaagggttggaatggtcttttaaccggatatggggaaggagttttggcaatgcatgttaaaccggtggaacatgccagccgtcaatatcaagggggaaaaaaacaggaaagtttttaaaaggggagttgaatccaatcaaggggggaaaggatcaatgactgggggcaacaaacggacataaaaaaattgtagaaccggggaaagtatggttgggcccaaaaaagggtggtagggggtgtagaaaacggggaaccaaggagagggggaacgctaaatagtgcgggggaacgctggggggcagccacatataaggctggcgaataatttgggcaagactgcgtcggggagggcggggaaatggggggaactacaaaacgccacctttctcc

SEQ ID NO: 89748 - DNA, 1084 bp, Zea mays
  misc_feature: Ceres CLONE 1577522
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (90)..(90): n is a, c, t, g, unknown, or other
  misc_feature (98)..(98): n is a, c, t, g, unknown, or other
taaataaagtgnnngnagtcccccagtntnngggcccttcnncnntttgnngttttgggggggcnnnnccaaaactggactcaggacggnggtggccncgtcccagtcaggaatgccccgggctgcttgcaaaaggcgagcgctagaaaaaactagctctgccctctgctcggggctcctccttcccagtaacaactaacaagtctacacacaggggacaccacaagtacatcgccaccgacggaggaggaacaacaagaaccccgatgacaattgcagccgcggtgaccgcgcccacgtccgcgccagtgcacgtcgcgccgcgccacgccagccccgcggtccagccgcgcgccgcgccgcgcagggagccgtcgccgctcaaccccaacgcgccggcgcaggcgctccgctccgtcagccccggcggcggcgggccccccacgggccgcagacagagcccgggctcccctcacacaacctgagaaggaactcgccgaaggcgggcccggatgccctaaggcccggaaagccagagcatcaccaaagcacgctgcgggcaaggggccgagggggctgggtctgggggagccgggagggcagcagagtcgggggggagccaggggggcctggcgttcaacgggggctcgagaacgtcagggcttggtgtcgggggactccggggccgccgggagagggtgggtgacggggggagaggaggacggcccgcggaagggaagtggagaggtggacagatcacgaaaagcagacggccttgaatggagcgtgaggcgaagaaaatgttttcttgtgttccggggagaaagttggcggcaggagaggggaggtggcgaaggaggggggggagaggaggattgggaggggaaaaggacagggagtgaagaaagataacagcagggggggaaagagtgacaggaacggagggaaagagatgcctccaaagcaaggacccaaatgggggagatacagatgaacaagtctacgcttcaaagagatacctaacttagagtgaagacgggagcatacaatagcacaagtaatgggaggagaggaggaggataag

SEQ ID NO: 89749 - DNA, 815 bp, Zea mays
  misc_feature: Ceres CLONE 1577524
  misc_feature: Encodes the peptide sequence at SEQ ID NO. 89750
  misc_feature (755)..(755): n is a, c, t, g, unknown, or other
ctccccgcggtggcggccgctctagaactagtggatcccccgggctgcaggaattcgtctcacccctagaaaaactctcactcagccagccccgccgtactagatggctagatgccaaaatcccatatcccttgtgaacctcctaaacctaagcgatggcggtggcagcatcgccggatttcctcttgctcttcctcttccattcattacctgctctcgcctccctcgcgccaccgccttctgcaggcaccaacgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatgccccccgtcaactacaccgtctcgggcgtccccatccgcctgctcgcgctctccgtctccgatcccgacgtcccgctcggccccggcgtcgacgagtcctacacgctctccgtgccacccaattccagctccgctgacatctctgccgccactccctggggcatcatccgcggtctcgagaccttctcccagctcgcctggagcagcggcgccgccgacgcgagcggccagccgatcgtccccagcgagatagaaaatctcgaaccaccccctagtcaccaccggcgggatcctcctcgacaccggcacggaactanctaccccgtccgttgaattcttcggcaacatcccggggcatgtgggctcccaacaagcta

SEQ ID NO: 89750 - protein, 219 aa, Zea mays
  misc_feature: Ceres CLONE 1577524
  misc_feature (70)..(187): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature (215)..(215): Xaa is any aa, unknown, or other
MPKSHIPCEPPKPKRWRWQHRRISSCSSSSIHYLLSPPSRHRLLQAPTPRVPQKVQVWPKPVSISWPLPAYAPISPSFNIRASPSHPSLRHAIAYYTRLIRTERYTPIMPPVNYTVSGVPIRLLALSVSDPDVPLGPGVDESYTLSVPPNSSSADISAATPWGIIRGLETFSQLAWSSGAADASGQPIVPSEIENLEPPPSHHRRDPPRHRHGTXYPVR

SEQ ID NO: 89751 - DNA, 750 bp, Zea mays
  misc_feature: Ceres CLONE 1577525
  misc_feature: Encodes the peptide sequence at SEQ ID NO. 89752
ctccccgcggtggcggccgctctagaactagtggatcccccgggctgcaggaattcgtctcacccctagaaaaaattcatctccaccgccgccgcatcagccatggcgcgccgccacctcgcctaccccctgcgcctctcgatcctctcccgcaatcccggagcccctgcccgctcgcgtcgcgccgcatgctcaaccacgcgcgctgcctcgtcctcgacaccatgccgtccttctccgtcgcgcccgacgagcccacgctcgccgcgctcatctccgcctacggcagggccgccatcccgcaggaggccgttaagctgttccggatgatgcccaacataggcgtcccccgcacggcgctctcctacaacgccgtactcaaggccatactctgccgcggacgcgaggccatggccaggcggatctacaacgccatgatcgcggacggggtggcgccggacgtgtccacctacaacacgctcatctgggggttcggcctgtgcaagaagatggagaccgcagtcagggtgtttggggacatgaagggccatggggtgacccctgatgtcaccacctacaacaccctgctgaacgcctgggtgcgtgccggtgatctggagagtgcgcgcaaggtgtttgatgaatggctgggggaggggaccgagcggaactcggtctcgtacaatgtcatgatcaaagggtacgtggaaggcaatagggtggaagaagcagtggcgttgttcgctgaga

SEQ ID NO: 89752 - protein, 187 aa, Zea mays
  misc_feature: Ceres CLONE 1577525
  misc_feature (93)..(127): Pfam Name: PPR Pfam Description: PPR repeat
  misc_feature (128)..(162): Pfam Name: PPR Pfam Description: PPR repeat
MLNHARCLVLDTMPSFSVAPDEPTLAALISAYGRAAIPQEAVKLFRMMPNIGVPRTALSYNAVLKAILCRGREAMARRIYNAMIADGVAPDVSTYNTLIWGFGLCKKMETAVRVFGDMKGHGVTPDVTTYNTLLNAWVRAGDLESARKVFDEWLGEGTERNSVSYNVMIKGYVEGNRVEEAVALFAE

SEQ ID NO: 89753 - DNA, 802 bp, Zea mays
  misc_feature: Ceres CLONE 1577532
  misc_feature: Encodes the peptide sequence at SEQ ID NO. 89754
ggagctcaccgcggtggcggccgctctagaactagtggatcccccgggctgcaggaattcgtctcacccctagaaaaacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaaccacaactgcctctgttctcgctaggagatcatcaaattgggcatggtgagcattacttcaggggcaaatccagggtcccgttaaaagggccattgataaaactggttcaaaaaatggggggaaggaactttgaaaaaaaatccaagggccggtcaaggggtaatggggggaaatttaaaaagcgtgttggccgccccaattcggccggggaaaatggaggaaattttgttggggggaaccattaattccccccaaaaactctttttgaaaaagggttggggccccctctaagagggtggccct

SEQ ID NO: 89754 - protein, 149 aa, Zea mays
  misc_feature: Ceres CLONE 1577532
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLARRSSNWAW

SEQ ID NO: 89755 - DNA, 796 bp, Zea mays
  misc_feature: Ceres CLONE 1577534
  misc_feature: Translation starting site: 188
  misc_feature: SWISSPROT Homolog: EC 5.3.4.1 Protein disulfide-isomerase
ctccccgcggtggcggccgctctagaactagtggatcccccgggctgcaggaattcgtctcacccctagaaaaagcccactgctcagtccactgcccagcacggatctcatctcaccagctgcccgcgcatccaattcctctcgctggacggctgcagcacatcatcaggtgagaccgtgagagggaatgggatcaacaacaatgtcccctccatcttttcccgtcgtcctcctgctcctcctcctcgccaccatagccgcagccgccggaagcaacatggatgaggaggtggtggacgacctccagtatcttattgacaactccgacgacatccccaccaacgatcccgacgggtggcctgagggagactacgacgacgacgaccttctcttccaagatcaggaccaggacctcacaggccaccagccggagatcgacgagacccacgtcgtggtcctcgccgccgcaaacttttcctccttgctcggcgtcagccaccatgtttatgggtgaggtctacgcaccttggtgtgggcactgcccagagctccccccggattacgcggcggccccagggattttgacgttaaccacaacaaggccaaccccccccttgcaagggcgacccccccgaggaaaccaaccttccccaaaaatacaaaccccaggggttccccacaatccctttttttaaaggaaggggggcccccccgaggcttatacggagcccggggcccaggaaaaccccttcccaacgggggtcccaaaaaaaaaccccgccccccccccgaaaac

SEQ ID NO: 89756 - DNA, 777 bp, Zea mays
  misc_feature: Ceres CLONE 1577538
  misc_feature: Encodes the peptide sequence at SEQ ID NO. 89757
ctcaccgcggtggcggccgctctagaactagtggatcccccgggctgcaggaattcgtctcacccctagaaaaagccagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagaggctggagggtgttcagctccttcggcaggggctacgtcgtcacgggccgccccagggtcatgggtcgagcccctcgccaggggccttcttcggggccaacaaagtcgtcgggacccaactggaagtccggcaggaacagccaaggccccgggcttcatgggccaggccggggtggcttctttggggacacaaaaaaaaaaggccccccctcaaggagattcggggaaaccctctgcccaaattctggatgggggggaataaggggaaacccaccttctcaccttct

SEQ ID NO: 89757 - protein, 208 aa, Zea mays
  misc_feature: Ceres CLONE 1577538
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPERLEGVQLLRQGLRRHGPPQGHGSSPSPGAFFGANKVVGTQLEVRQEQPRPRASWARPGWLLWGHKKKRPPLKEIRGNPLPKFWMGGNKGKPTFSPS

SEQ ID NO: 89758 - DNA, 841 bp, Zea mays
  misc_feature: Ceres CLONE 1577539
  misc_feature: Encodes the peptide sequence at SEQ ID NO. 89759
  misc_feature (242)..(242): n is a, c, t, g, unknown, or other
  misc_feature (300)..(300): n is a, c, t, g, unknown, or other
  misc_feature (301)..(301): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
  misc_feature (328)..(328): n is a, c, t, g, unknown, or other
  misc_feature (722)..(722): n is a, c, t, g, unknown, or other
  misc_feature (746)..(746): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
aaagctggagctccccgcggtggcggccgctctagaactagtggatcccccgggctgcaggaattcgtctcacccctagaaaaaagggaccccgacgcgacccgcgtgtgcttccgttccagctttccttccccaacagctcgacttcctccgcaagccgccgtgccagtcgccgccggccgcgatgggtagcagggtggcagcggcgctgatccggcggggcaggtacctggcatcctccnctgctgacgcctcgtctgccgagaagcgccctcgctccggctccaccgcataggggtnntggatctgccntnncctccctcttgcngcgggcgggcggcggcgggaagctgccctcctccccgccaagggtcttgggggccagccgggggggccctttctccttaacgccttccccggggtttcggggaaaactttccaacgccttttccgaattccccttggcgtccccaaaggggcccatgtttttggggccccaatgggccccaaaaggaaaaaaaatggcaaaactttacggggggaaacggccccctgggaaacctcaaacgtggggggcccagggggggaaccacccaaaattttccggggggatttcaaagcgggggggttggtttaaaaaaaaaagagggggcgcccaatgtgtggcccaaaaaaaaaaggcggggtccccgggggaaaaaataaaaggggggcccctcctntttggggggggggggaggggcggncctgcgccccccccggggggggggggggtgttccccaaccactcctttggggggggagagaaaaaaacacccctnnngggagaaaggagagaaat

SEQ ID NO: 89759 - protein, 36 aa, Zea mays
  misc_feature: Ceres CLONE 1577539
  misc_feature (20)..(20): Xaa is any aa, unknown, or other
MGSRVAAALIRRGRYLASSXADASSAEKRPRSGSTA

SEQ ID NO: 89760 - DNA, 1080 bp, Zea mays
  misc_feature: Ceres CLONE 1577541
  misc_feature (11)..(11): n is a, c, t, g, unknown, or other
  misc_feature (12)..(12): n is a, c, t, g, unknown, or other
  misc_feature (68)..(68): n is a, c, t, g, unknown, or other
  misc_feature (69)..(69): n is a, c, t, g, unknown, or other
  misc_feature (74)..(74): n is a, c, t, g, unknown, or other
  misc_feature (75)..(75): n is a, c, t, g, unknown, or other
tgggggggggnngggggggtggggggactaccatactattattataggatgaaaattggggggggggnnctggnntggggaaaactggagctccccgcggtggcggccgctctagaactagtggatcccccgggctgcaggaattcgtctcacccctagaaaaaattagctgcgcttcaccggacgatggtgccaccgataacacaagctagctttgttgtcactgcacttctatgcagtgatatacctggatacatgctactctgcacgcacacgtgctgcattaatctgaacttaaggcggtagccgtaactcctctctatctccggctctgacggacgacgttgccatggttgctcaactgcatcacgcactatttcgaactgctgcgcgaaggagcagcaggcaacgagctatgtgtgctctcgatccccttatacctggtgctcctgcctctcctgctacggtacgtctcagcgtcaggcgtgtcgcttctgctacgacacaaccacggtagcggcgggcggggcacgcgacccccgaaaaagctccctgagctctgcgtgtctgtccgccggcccccgtggaagacctgccccatccagggctgtgtaagccctgcccacccctgaatgggggggggaacactccccccctttccggtggtgtaaacccccaagccgggggagttccgcccccacgccaaaaggaaaggccggtggccccggggcttaacccctgtggtttggaccttgccccatccccccccctctgggggtgcccccccggttggggcgggcaccccgggtggaaaacgggctctctggggggggggattccgaggccctcctgggacccaaaaatggtttttttgcgcctccccccccgccccttgacaaaccccaaattttttgggtattgcgtgtgcaacacccccccgccggacttcaaggtgggtaggttaccgaaacattgccgtccgtgggacttggggcgcctcgtccgacacgttgggggtatttgggggcccctttattgttgtaaccaccttccccaggatagggcccgggaatatctttt

SEQ ID NO: 89761 - DNA, 831 bp, Zea mays
  misc_feature: Ceres CLONE 1577544
  misc_feature: Encodes the peptide sequence at SEQ ID NO. 89762
ctccccgcggtggcggccgctctagaactagtggatcccccgggctgcaggaattcgtctcacccctagaaaaaatcccacgcggcgcccatgccagccacacctgttcgaccacctgacccgcgcgcgccctgatggctcccgcgctcacctccaacccgccctccttccgtcccctaacgtccccactccgccgtcgtgccgccaccgtcccatgccgcgtcggtaagcccggcaaggactcctccgctgcggatgacgctaccggccccaacaagaggcccaacctcttcgcggacttcgggaatgccaagtcgctcatacaggcgttcccgtcgcagtcgctgttcgcgggcggtggcaggggcaggaaggacccgcagacggtgttcgtcgcaggcgccacagggcaggccggggtccgcatcgcgcagaccctgctgcggcaggggtttgccgtgcgcgctggcgtcccggacctagcgtcggcgcaggagctagcgcggctggcggcggcataccggctcatctcccccgcggaagcgcggcggctaaacgcggtagaggcgggcttcggtgaccccgacgcgatagccaagtccatcggccccgccgcgaaaggtggtggtcaccgtcggctcggccgagaaagggccagaagggcggaggcgtcaccaccgacgacggcgctccgagtggtgcggggccgcagatctcgccagcgtggcgcacgttcgttgtcgtgtatgaacaaggggggcgggccagcggcggcccttggcgcgggggggcttccactttacaatgtgctcgaacggcgtgtacgtttta

SEQ ID NO: 89762 - protein, 232 aa, Zea mays
  misc_feature: Ceres CLONE 1577544
MAPALTSNPPSFRPLTSPLRRRAATVPCRVGKPGKDSSAADDATGPNKRPNLFADFGNAKSLIQAFPSQSLFAGGGRGRKDPQTVFVAGATGQAGVRIAQTLLRQGFAVRAGVPDLASAQELARLAAAYRLISPAEARRLNAVEAGFGDPDAIAKSIGPAAKGGGHRRLGRERARRAEASPPTTALRVVRGRRSRQRGARSLSCMNKGGGPAAALGAGGLPLYNVLERRVRF

SEQ ID NO: 89763 - DNA, 969 bp, Zea mays
  misc_feature: Ceres CLONE 1577545
  misc_feature: Translation starting site: 153
  misc_feature (264)..(264): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (297)..(297): n is a, c, t, g, unknown, or other
  misc_feature (316)..(316): n is a, c, t, g, unknown, or other
  misc_feature (317)..(317): n is a, c, t, g, unknown, or other
  misc_feature (872)..(872): n is a, c, t, g, unknown, or other
ctggagctcaccgcggtggcggccgctctagaactagtggatcccccgggctgcaggaattcgtctcacccctagaaaaactcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcgggngccggggggccgggcgnnnnnnnnnnnnnnannaaaaaaaaaaaaaaaaaannaaaatttaataataattaatttaaataaatattttttatttaatataatatatattaaaaaaatattttttatattaaaaaaataatatttatattaaaaattataataaattaaattattaaaatatactaataattaataaatttatatatttattaaataaaaaatataaaatatattaaaattattaaatataaaattaaaatatccacaaaaccaccctaatcacaaaatatccccaaacctctattcataaacaaacaaaacaaaatttcttactcaaatactttcccccctccactccctacacccctattcaacacaccccaccacccccataaccttccccctcctacctattctatatccatattacattttaaaccaccatctaaaacaattcttaacacctccctctcctcccaactaaacctttcctcatatcaacgtcttataaaatatcctctaatcactataaaaactacctatcctctccacatcccattcactatggtatagacgatgcgggtcatgggcacgagcgagatccctgngacttatgcggttgtgcgtggaatgcgactggagtggaaattgaggtataaaccaagatggggcggtaggtatagctactcaccgcggtcatcgaag

SEQ ID NO: 89764 - DNA, 844 bp, Zea mays
  misc_feature: Ceres CLONE 1577546
  misc_feature: Translation starting site: 380
ccccgcggtggcggccgctctagaactagtggatcccccgggctgcaggaattcgtctcacccctagaaaaatgtttggagcctaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtggccggtcaagaccaacacgatcgtgaagcccaggcctttgcaggctgcaagcattccaggactccttgggatttttcagaacgagtgggatgctctcatgctttctaaatttgctttggagcagcagcttcacacagcaagacaagaacttagtcatggactctaccagcatgacgctgcctgccgtgttatagccggattaaagaaggaaaagagatgacccttgaagcacttttgggctcaagctgagaagacagaaatccctggcgtcagttgcaagaaactgccccctggcaccctgttgttttcccaatgggaaaaaaaagataatttgaaaaaataaatattgtgcccctgaaacggggaaaaaaacaatcccctccccggggaaatacaacccctcgggccatggaat

SEQ ID NO: 89765 - DNA, 1144 bp, Zea mays
  misc_feature: Ceres CLONE 1577548
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (781)..(781): n is a, c, t, g, unknown, or other
tgggtttgttgtgtggggcgttgcggggccggatatgatgcgtgaacaataacaaaaaaatgcctcttcgnnnnnntcaaactggagctcaccgcggtggcggccgctctagaactagtggatcccccgggctgcaggaattcgtctcacccctagaaaagcttttgagtggagccgctgtggagtggacggtgtggtgtggtgtgggtcggcggtgaggtgaaaggcttggtttctttctttcttgcgagggaggataagggaaagggaaggcgaagaggaggatggccggaggaggggcggcgccgccgccgaagcaggaggagctgcagccgcacccggtgaaggaccagcttcccagcgtgtcctactgcatcacaagcccaccgccctggcctgaggctgtcatccttggattccagcactacattgtgatgctgggcacatccgtcatcataccaagtgctcttgttccccatatgggaggagggaaacgaggagaaggccagggtgattcagacgctgcgtgttcgttgccgggcatcaacacccctattgccagtcatttcttatgggaactcgccttccccagcggtggatgggttggaatccgtacaaccaatcggtcgcagcccacccattttcccataaattcagtgggcgggggcccgttttccagggcaaacggaaggccagcacccccgtcggtgagaaggaaaattgcctttgttcgccggaaccctctcgcccctagggcgaaaacatccataggggggacggnctttccttacaactcttatgtcagccccggaaccgcaaaccaaattttccacaggatatccgaggtagccctttagtgggtttttccacagagtgggagcccctttttgatggaccagctaaattgtgggcccgttcacaaacaatatcgccgtggaagacccccccaaattgtattctcgggactaggtacaacccttatatgggttattttcgccttaaagagtttggaagattgtggaggggggtatttcggaagcccccttcggatcgtattccaccgaggaagcacggccccgtcagagtatgtgtccggtccaacataggagcgcgttttccaagcgcacagaagcactcagcatat

SEQ ID NO: 89766 - DNA, 786 bp, Zea mays
  misc_feature: Ceres CLONE 1577549
  misc_feature: Encodes the peptide sequence at SEQ ID NO. 89767
ggagctcaccgcggtggcggccgctctagaactaggggatcccccgggctgcgggagttcgtctcacccctagaaaaaaccttaatcccatgctgtactcggcccctccgccaacatgtgtgtggtgtctgagccgctaagcatatctctccccgacaagatctacatggtggagatgtttgtggtggagctcatgacgctgccgctcagcttcagcttccgccccaccgacgaggagatcgtcacccactacatcaagggcaagatcactggcaggatggacgccgagtcccaggtcatccacgagatggacctctgtatgtgcgagccgtgggacctcctatataagtccctgatccagttcaaccatactgagtggttcttcttcatccccaaggagcgcaagtaccccagcggtagcatgtctaacatgggcaccgaggtgggatactggaaggctactggcaaggacaggataatcaaatccgacggcgacgagcagcgacatcatacaatccgaatgaagaagagcctcgtcttccaccgaggtcgggcccccaaaggcgagcgcacggggtggattatgcatgagtaccgcaccactgagctagagttccaataccgcgagcactgaggttatgttcgttaacacctcttacgtaatcaagacgagaagactgagcgctcctgaccagaggaagtggatacaagtggctactcacgtagtccttcacgttctcacctgacaacctacaggctaatgatgaagctgatgcacagttaaat

SEQ ID NO: 89767 - protein, 172 aa, Zea mays
  misc_feature: Ceres CLONE 1577549
  misc_feature (29)..(163): Pfam Name: NAM Pfam Description: No apical meristem (NAM) protein
MCVVSEPLSISLPDKIYMVEMFVVELMTLPLSFSFRPTDEEIVTHYIKGKITGRMDAESQVIHEMDLCMCEPWDLLYKSLIQFNHTEWFFFIPKERKYPSGSMSNMGTEVGYWKATGKDRIIKSDGDEQRHHTIRMKKSLVFHRGRAPKGERTGWIMHEYRTTELEFQYREH

SEQ ID NO: 89768 - DNA, 847 bp, Zea mays
  misc_feature: Ceres CLONE 1577551
  misc_feature: Encodes the peptide sequence at SEQ ID NO. 89769
tggagctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaagctcaagaaaggtgggttcgccgacgagggctccgccaccaccgagtccgacatcgaggagacgctcaagcgcctcgtgtccgaggtcggcaagtcccccgaggaagtgttcgaggcgctcaagaatcagaccgtcgacctcgtcttcaccgcgcatcccacgcaggtccgccggccgctcgctcctggagaaaaacgcccaggatccggaaattgtctgaacaagctgaatggccaaggacatccctgaccaacgacaagcaggaagctcgaaggagggctcttgcggaggagagattcaaggcagccttta

SEQ ID NO: 89769 - protein, 207 aa, Zea mays
  misc_feature: Ceres CLONE 1577551
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGFADEGSATTESDIEETLKRLVSEVGKSPEEVFEALKNQTVDLVFTAHPTQVRRPLAPGEKRPGSGNCLNKLNGQGHP

SEQ ID NO: 89770 - DNA, 1175 bp, Zea mays
  misc_feature: Ceres CLONE 1577556
  misc_feature: Encodes the peptide sequence at SEQ ID NO. 89771
  misc_feature (16)..(16): n is a, c, t, g, unknown, or other
  misc_feature (63)..(63): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttttttattccaancccctccccgggggagcacgggcgtgacggcgtacattgggggaaanaggtaaaannnaaaagctggaactccccgcggtggcggccgctctagaactagtggatcccccgggctgcaggaattcgtctcacccctagaaaaagccagtgcccgtgcccgcgccgcgctagcctagctgctcctgcctggttagccgtatcccgtaccacaacaaccacaacgaaaaaaaaaaatctccgcgcctcgggggataggtggtcttgttcaccttggggagcagcggccggccggcggcagagaaatgcagagtggcgtcttcttcctcaacggcaacgaccgcggcatggcggactacggcggcagcctcacagtacccgtcagcgtgatctgcctcaaggaggccgtcagcgggctcttctgcgacaacaacattggcctctcaggaggtgtgtacgacattggagggatttcctggaaaaggttttccccggggttgctcaagaggaacggcccccttcacccccggaccctgaaattgcattgtgacaacaaccaagaccccgtggtgggcctttcacaggcaaccgcctttgcccacgtttctgagctatgcctggggggatcgccttcaatggccgaaaacctttgttagtccccggggcgggaaaaggggggggataaacaggaccccgccctaccgagggggtgtaaatctcgggacgagtcgcgggcacactgtgttatataatctgagaatcggcggggtgaaaacctcttctcctataaaaaaaacagagctccgggggcgaagagcgcgggaaaaaaaagcctcagactccccccccatgggaccttctccaggtggaccccccggcgtacgggaacaatagcaattgcgcctccgcccgcctgaaaggggggtttatgcgcgcatattttgtctgccggggcgtaaataacaagcagcattctggggagatttccccttcggcatgaaaagggggggtgggttgccccacccagacaaagttcgatgggggccggcattttggatcctccggggctgtattcgccccccgctattacggggggtgagcgggggtaaccctgggggggcgcgcccactttttcggagaaagagcccccccacgaaagacc

SEQ ID NO: 89771 - protein, 116 aa, Zea mays
  misc_feature: Ceres CLONE 1577556
MQSGVFFLNGNDRGMADYGGSLTVPVSVICLKEAVSGLFCDNNIGLSGGVYDIGGISWKRFSPGLLKRNGPLHPRTLKLHCDNNQDPVVGLSQATAFAHVSELCLGGSPSMAENLC

SEQ ID NO: 89772 - DNA, 829 bp, Zea mays
  misc_feature: Ceres CLONE 1577557
  misc_feature: Encodes the peptide sequence at SEQ ID NO. 89773
ctccccgcggtggcggccgctctagaactagtggatcccccgggctgcaggaattcgtctcacccctagaaaaatcccaggctctcaactcccagtagaaaacttcaccggctgcctgcctgcccacagaaattgcgcccggccgccccccattcaccttcaaaaaaggagccaggcttgccatcaacgagggtgtcggccatctgagcagctcccctgcccctcgcagcggctactctacaggtctagcgactctttcgccatccatagagggaggaggcgcggcggagatggtgggcggtggcggcggcgggccgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagaacaagatggccgaacagattaagagagaaatatccataatgaagcttgtcaggcatcccaatgtcgttaggctacacgaggttttggcaagccggaagaagatatttataattctggagttcatcactggcggcgagctattcgataaaattattcgtcatgggagactcagtgaagcagatgcacgcagatactttcagcagcttatggatggtggttgattttgtcacaagaaaggagtctaccatcgagacttaaagcctgaaatctcctccttgattccaaggggcatctaaaatttcagacttttggactgagtgcatggcctgctcagggatctttccttctacgtacaacctgtgggactccgaactat

SEQ ID NO: 89773 - protein, 127 aa, Zea mays
  misc_feature: Ceres CLONE 1577557
  misc_feature: SWISSPROT Homolog: EC 2.7.11.1 Non-specific serine/threonine protein kinase
MVGGGGGGPLRRVGKYEVGRTIGEGTFAKVKFAQNTETGESVAMKVLDRSSILKNKMAEQIKREISIMKLVRHPNVVRLHEVLASRKKIFIILEFITGGELFDKIIRHGRLSEADARRYFQQLMDGG

SEQ ID NO: 89774 - DNA, 831 bp, Zea mays
  misc_feature: Ceres CLONE 1577560
  misc_feature (408)..(408): n is a, c, t, g, unknown, or other
tccccgcggtggcggccgctctagaactagtggatcccccgggctgcaggaattcgtctcacccctagaaaaaacctccccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctaagcagcagctatagtagctgagcgagtgcgtccatcgatcggagtcgtccacctccgtctccctttgcgattcggcgtcgtgaactcgtgttcttgagcgtgggggcaaggggcagatcaacaaggagacacttcttcttcttctttancacaaataagaaaagcagcacggcaatggagggagctggtctgcagtgacagtgacacgagccatggatcccgagccattcgtgcggctctcagttgggcagctcggtctgaagctcccgggcgggacgctagcaaggcggcggccgggtctgccactgcgaaatcggcctgggcggtttccggggcaaaacgctccggggccgctggtccactccccggggtttaacttgaaccatttcccaaacgggggggttttttccctcaggaaatcccaaactcaaggccttggggggccccggggggtttccgggcccccgggggtctttggccttagggggcccgggggtatataacggggcccccttttgggggcttacaacgcttgggggtgcccccccccggggggagaaaaacgggggggg

SEQ ID NO: 89775 - DNA, 860 bp, Zea mays
  misc_feature: Ceres CLONE 1577563
  misc_feature: Encodes the peptide sequence at SEQ ID NO. 89776
ctccccgcggtggcggccgctctagaactagtggatcccccgggctgcaggaattcgtctcacccctagaaaaactacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttggtgggagctgcgctgcagctgcttgccccctcgcgtttctttgctcaattgggggtgtcgcgcgtgctcgtgggcggaattcggtgttcttgcttgcgcggtccacgtccccgtccccgtccccatcccttggcgcgattgcggttgcggacgctcgctgcagatcttcgcgcgactccgggagcgccgccggagatggactgcgggccgcccgaccagctggccgcgtcgtcggcgccggcgtgcttcctcaacctcaactgggaccagtccatggccggcggccacggccggcgaccacctcgacctggtctcctccccggcgtccaactcgacggggggctgacggccttccttcttcacgggatctccccggcagcccccagtacggaggcactcccgcttcgcttcgccccgcaaggctgaaacctctccagtgaaggggcaagtttcccccactacccggcccaagggggccattctaaaaccaagttcctcgccccaaaccaaggttttccccccccccccgcccggggaagggctcttcccggggtttcaaaaggccccccc

SEQ ID NO: 89776 - protein, 76 aa, Zea mays
  misc_feature: Ceres CLONE 1577563
MDCGPPDQLAASSAPACFLNLNWDQSMAGGHGRRPPRPGLLPGVQLDGGLTAFLLHGISPAAPSTEALPLRFAPQG

SEQ ID NO: 89777 - DNA, 836 bp, Zea mays
  misc_feature: Ceres CLONE 1577568
  misc_feature: Encodes the peptide sequence at SEQ ID NO. 89778
ggagctccccgcggtggcggccgctctagaactagtggatcccccgggctgcaggaattcgtctcacccctagaaaaactcaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctcaatggtcctcatcaagatgaaggagattgctgaagcctaccttggttccaccatcaagaacgcagtggtgacagtgccggcctatttcaacgactcgcagaagccggccatcaagggacgccggtgtcatttgcgggcctcaatgtgatgggtatcatcaacgaggcccactggctgctgctattggcctacggtcttgaaaaaaaaggccaccagcttcggggaaagaagaaactgcttcattctttcaacccttgggggtgggt

SEQ ID NO: 89778 - protein, 172 aa, Zea mays
  misc_feature: Ceres CLONE 1577568
  misc_feature (8)..(173): Pfam Name: HSP70 Pfam Description: Hsp70 protein
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFKVIPGPGDKPMIVVNYKGEEKQFAAEEISSMVLIKMKEIAEAYLGSTIKNAVVTVPAYFNDSQKPAIKGRRCHLRASM

SEQ ID NO: 89779 - DNA, 1015 bp, Zea mays
  misc_feature: Ceres CLONE 1577571
  misc_feature: Encodes the peptide sequence at SEQ ID NO. 89780
  misc_feature (73)..(73): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (87)..(87): n is a, c, t, g, unknown, or other
ataattaaatgggtgagggggagttctaccgtcctgtatgggcgagaggagctcttgcaacgggggcagcatntttgtgannncgcnttaatctggagctcccgcggtggcggccgctctagaatagtggatcccccgggctgcaggaattcgtctcacccctagaaaaacctctcgaaaccctagtcccctgctccattctcagccgccgccaatcccttcccgtgctccgcaaccgctgagtgagaagaagagatggccggcaagggcgatggcccggctatcggcatcgatctcgggacgacgtactcttgcgtcggcgtgtggcagcacgaccgcgtcaagatctttgccgacgaccagggtaaacggcaccaagcccttgtaaagtcgccctttaccaaatccgaagcgcctccatgggaaaagtcggcccaaaaaacccgggtcccccctggaaacccccattaaaaaaccggttttttttaatggcccaaagggtttctcattgggcggggggggggttccagggggaaggcggcttcgttgcccccagagggggaaattcccaggttttgggggggccccttttttaaggggggccttttttttttgggggggcccctgggggtggaaaaaaaaccccccccctggggtgttgtggttttgttcccccccccccccccaagagaggggggttttatagaaaaaaaaaaaaaaaccctcttttttttgtgcgcccctcgtgaaaaaaaaaaaaaaaccccccccccccctccaggggggggggggtcctttttataaacaaaaaaaaaaacgcgggcgggagaaaataattttttgttacaagaaaaaaccccacccccccccggcggggggggggcgccgcccccttcattataaaaaaaatatcacggtgtggggggggggaaaaagaaagaaaaacaccccggcggcggggaagaataatatttgttttggaggggggctccgccgcccccagaggggagggggg

SEQ ID NO: 89780 - protein, 71 aa, Zea mays
  misc_feature: Ceres CLONE 1577571
MAGKGDGPAIGIDLGTTYSCVGVWQHDRVKIFADDQGKRHQALVKSPFTKSEAPPWEKSAQKTRVPPGNPH

SEQ ID NO: 89781 - DNA, 837 bp, Zea mays
  misc_feature: Ceres CLONE 1577572
  misc_feature: Encodes the peptide sequence at SEQ ID NO. 89782
ctggagctccccgcggtggcggccgctctagaactagtggatcccccgggctgcaggaattcgtctcacccctagaaaaaatggccgccatggacctcctctccggcaagctcatacgctccctgcgtctccattcctcactcctcccctctgctccttcctcctcccgcgccgtccccacatcccgccgtctccggcgccgccgccatgccctcctgtactgccgccttaccaccacctcctcctcctcatctgcctccaccaccacaaccaccggggtggaggaagacgtcaaaagccaggacctttcctccctactcacctcctccgaaccttctgccgagcccgccgtcgggaccaagaagaagcggtcgggcggcagcaacggcgcgtctagcatcccgtccggggtgcggctggagggaatctccaagtcctacaagggcgtgacggtgctcaaggacgtgtcctgggaggtgcagcgcggcgagaatgtggggctcgacggagtgaacggcgccggcaagacgacgcagctccgcatcatcgcggggctcgagaagaccgacggcggcgccgtcatcaaggccatgagaaacatgagatcgcctttcctcagccaggagttcaagagtctccgactcccgcaccgacaaggaagagttcttcagcgccttctaagaagagattggagtcaagcggcggctcgagcaagtgcatgcggcgctccgaggcgccactgaagacatggacctcatgggcaagctcctccaagagctcgaactgctgcagcgccgctcccaggacgtggacttcgatatgggggacgtcaagtga

SEQ ID NO: 89782 - protein, 220 aa, Zea mays
  misc_feature: Ceres CLONE 1577572
  misc_feature: SWISSPROT Homolog: EC 3.6.3.31 Polyamine-transporting ATPase
MAAMDLLSGKLIRSLRLHSSLLPSAPSSSRAVPTSRRLRRRRHALLYCRLTTTSSSSSASTTTTTGVEEDVKSQDLSSLLTSSEPSAEPAVGTKKKRSGGSNGASSIPSGVRLEGISKSYKGVTVLKDVSWEVQRGENVGLDGVNGAGKTTQLRIIAGLEKTDGGAVIKAMRNMRSPFLSQEFKSLRLPHRQGRVLQRLLRRDWSQAAARASACGAPRRH

SEQ ID NO: 89783 - DNA, 818 bp, Zea mays
  misc_feature: Ceres CLONE 1577574
  misc_feature: Translation starting site: 205
  misc_feature: SWISSPROT Homolog: EC 1.4.1.2 Glutamate dehydrogenase
  misc_feature (775)..(775): n is a, c, t, g, unknown, or other
  misc_feature (780)..(780): n is a, c, t, g, unknown, or other
gagctccccgcggtggcggccgctctagaactagtggatcccccgggctgcaggaattcgtctcacccctagaaaaaccctagaaaaaaaaatctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctgggcctcatgtgctgcgtatcatcaatgagccaaccgctgctgctattgcctatgggtctgacnagaanggcaccagcgtcggtgaggagaatgtcctcatctttga

SEQ ID NO: 89784 - DNA, 805 bp, Zea mays
  misc_feature: Ceres CLONE 1577575
  misc_feature: Encodes the peptide sequence at SEQ ID NO. 89785
  misc_feature (673)..(673): n is a, c, t, g, unknown, or other
  misc_feature (728)..(728): n is a, c, t, g, unknown, or other
  misc_feature (762)..(762): n is a, c, t, g, unknown, or other
  misc_feature (800)..(800): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
ctcaccgcggtggcggccgctctagaactagtggatcccccgggctgcaggaattcgtctcacccctagaaaaagcgccgccgccgccgccgcttcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcttgtgtttctgtaagctagcaaacagttccagaaggcttttgttaagattttgatgacgctaagaggattgatgctactatgctgtactcaggattccatgctgcattgcgatgctaaattaaagaacctctgctaccttaaaaaaaaatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggncggtggcgaaggtggctacaacaagtcggggcggcgatgacaactacggccgcancggccggcaatgggtaccggaaggtccggggggnaaaaatcgctggccgggggggaaacggacataggcatnannnt

SEQ ID NO: 89785 - protein, 51 aa, Zea mays; identical to SEQ ID NO: 2355
  misc_feature: Ceres CLONE 1577575
  misc_feature (9)..(51): Pfam Name: Ribosomal_L39 Pfam Description: Ribosomal L39 protein

SEQ ID NO: 89786 - DNA, 807 bp, Zea mays
  misc_feature: Ceres CLONE 1577578
  misc_feature: Encodes the peptide sequence at SEQ ID NO. 89787
  misc_feature (723)..(723): n is a, c, t, g, unknown, or other
ggccgctctagaactagtggatcccccgggctgcaggaattcgtctcacccctagaaaaaaagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgaccgccccttacagggatttcttctggtggcaagggaagtggctagccaccaagttattgataccaagcccgcccttgagaaaccatcagattactcccttgtttggaccagtgctgacgcacatgaagatgacaatagcgaatgtggttgcatctggctgccatgtccaccgaatgggtataaagcccttggctatgtggttactaaaggaccaaagaagccatcactgggagcagttcggtgtgtgcgagatgaccttacggacacgcggcaaaattttccatcaattgcgaataatgggacacgcatgccagatttggaagacaaagccttgcccaccnatgagtggggagggcgtggtaatccgggtcggtacattcctcgtgcgaaaccgattccaccaaataccgatgaatccaggccca

SEQ ID NO: 89787 - protein, 231 aa, Zea mays
  misc_feature: Ceres CLONE 1577578
  misc_feature (20)..(228): Pfam Name: DUF946 Pfam Description: Plant protein of unknown function (DUF946)
  misc_feature (204)..(204): Xaa is any aa, unknown, or other
MGGWNWLFCGRSKAGGGELRPPEPFQLPAPLPEWPQGGDFAKGTICIGEVDVTSITKFRSIWTCSDATFYEPEGIPDGFHCLGHYAQQNDRPLQGFLLVAREVASHQVIDTKPALEKPSDYSLVWTSADAHEDDNSECGCIWLPCPPNGYKALGYVVTKGPKKPSLGAVRCVRDDLTDTRQNFPSIANNGTRMPDLEDKALPTXEWGGRGNPGRYIPRAKPIPPNTDESRP

SEQ ID NO: 89788 - DNA, 1091 bp, Zea mays
  misc_feature: Ceres CLONE 1577581
  misc_feature: Encodes the peptide sequence at SEQ ID NO. 89789
  misc_feature (15)..(15): n is a, c, t, g, unknown, or other
  misc_feature (61)..(61): n is a, c, t, g, unknown, or other
tttttgtttttatcngttcactttttcacataaagatcgggtccatctcgaagaaaaagangggtgaattttaaaataagaagctccccgcggtggcggccgctctagaatagtggatcccccgggctgcaggaattcgtctcacccctagaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcagggggcggaagaagggcgtgtgtcaacgtactggcaatcaccctacaatcctccagctggcatcaccaaagcacctcttcccccaggtacaaaaagttccttatggaatggggcgtggtcccttgggtgggcaattggccaactttcccctggctccttttcctccaaggggttttgaaatccgtggggccttcgtggggcccaaaagctcccacaccaggaaaaaggggaatttttgaaacccaccccaaaggggttttggtcccaaaaaaaaaaatttctcctccccaaaaggggtattttatttttttcctggggcaaaaatggggcccataaggggggcccacattgggtttgccccggggccccataattttttcgcaaaattttttccctttggcgcggaaaaaacacagggggggtttttggggctccccgggtggggcctcccctttttagaaagggcccgccgcggctttgtgctttccccggaggaaaatatgggagaagggggcaaatatatatttctttatcacaccacgggggggggggaggaaaaatattcggcgaaatatttcctctcttcag

SEQ ID NO: 89789 - protein, 157 aa, Zea mays
  misc_feature: Ceres CLONE 1577581
  misc_feature (4)..(157): Pfam Name: DUF791 Pfam Description: Protein of unknown function (DUF791)
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGAEEGRVSTYWQSPYNPPAGITKAPLPPGTKSSLWNGAWSLGWAIGQLSPGSFSSKGF

SEQ ID NO: 89790 - DNA, 858 bp, Zea mays
  misc_feature: Ceres CLONE 1577582
  misc_feature: Encodes the peptide sequence at SEQ ID NO. 89791
ctggagctccccgcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtctccaagtctgaccagattgttgttgaagaagtccactggtccctgtcaagaccgctgaggctattgagaagaatcttgacccccaacagcaagggcatcaactaccagatccttttcaacccaaaagttccttggcggagggcactgcccattggaggacctggttcaaagcctgacaaaggggctttatcggtgggccgggaggaccccctgagggcagggaagggcccttccagggttctcaagggatgggtaacgcctccg

SEQ ID NO: 89791 - protein, 204 aa, Zea mays
  misc_feature: Ceres CLONE 1577582
  misc_feature (2)..(202): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDQIVVEEVHWSLSRPLRLLRRILTPNSKGINYQILFNPKVPWRRALPIGGPGSKPDKGALSVGREDPLRAGKGPSRVLKGWVTPP

SEQ ID NO: 89792 - DNA, 812 bp, Zea mays
  misc_feature: Ceres CLONE 1577584
  misc_feature (698)..(698): n is a, c, t, g, unknown, or other
  misc_feature (768)..(768): n is a, c, t, g, unknown, or other
acccgcggtggcggccgctctagaactagtggatcccccgggctgcaggaattcgtctcacccctagaaaaatcaaaaggttattttgctaatctcctcttcgatttgtcaagactgaaggcatgattaaaaccttgtgtcgtcaactttggatagttcgtttcagttttggtgctttgttgcggtcaaaaatctcatgtgcaattcccctgagaagtcccacaactcgctcctaccatgatgttagtactatctttacaaacagaaacatgcactcgtgtttgtaaattcatctatgtctctatggtgtgcttttgatataattaacttgtactgaatgtaagactcttgctctgtgtactatagtgttctgctgctgacatggttggattattttttcgtatatataagtgctaatgatagtccatctagttgtgccagctttggttagccacttcttgtaagacccatgtgagtacctagttattgaggacatttgactgcaataaaaaacaaactgactgcgcattggatgttattcttcttgtgaagtgattactggttcttctctttgaaaagttggttctcggcttctcgctcaccagctggaagtttattttgaattggattgcattgtgattattttactactttgtgagctgtcgaatctgtagttcttaatataatgatatttagcntcttctacgtgtttgattaaaaattctctagctcttttttattgtccccgtcttcccgaggacagattcnacaatgttttttgtttcatgtctaatgtggaagtctctcagaac

SEQ ID NO: 89793 - DNA, 1270 bp, Zea mays
  misc_feature: Ceres CLONE 1577588
  misc_feature: Encodes the peptide sequence at SEQ ID NO. 89794
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (59)..(59): n is a, c, t, g, unknown, or other
  misc_feature (1134)..(1134): n is a, c, t, g, unknown, or other
  misc_feature (1270)..(1270): n is a, c, t, g, unknown, or other
nnnnnnnnnnnnnnnttttcccctgcgggcgggcttcccctgcccctccgtactcccanattatttaaaaaaaaaaaaaactgaactcaccgcggtggcggccgctctagactagtggatcccccgggctgcaggaattcgtctcacccctagaaaaatcccaggctctcaactcccagtagaaaacttcaccggctgcctgcctgcccacagaaattgcgcccggccgccccccattcaccttcaaaaaaggagccaggcttgccatcaacgagggtgtcggccatctgagcagctcccctgcccctcgcagcggctactctacaggtctagcgactctttcgccatccatacagggaggaggcgcggcggaaatggtgggcggtggcggcggcgggccgctgcggccggtgggcaagtacgaggtgggacgcaccatcggggaaagggaccttcgcccaggtcaagttcgtgcagaaaacccagaccggggagagggtcgccatgaaagggcgtcgaccgcatccttccatccttcaagaacaagaatggcccgcaccccatttaacaagacaaaattatccctaaaatcgaaagcgtgggtagaggaattccccaaaggtctcctatagggcctaccacgaaggattttttgagcaaaaccccgggacacaaaacattattgtcgctaagttactggggaattttaacaaaccccttgggcgctgcggaatacacatattttcgacaataaacaaaatatgtagatgtcgggaatttcatggtgagataaagttatcacaagtggttaaaaaacagacaaggatcggtcaacccccgtataatacaaatcgcagtaatttgccgaagtccacgaccagctatatatcgtccatcagccagcggcagaggtaagccaaagacaattcgtccaacggcagccagagcaagaagacagagtgcgtagatttcactaagctcaagactacagcaggacactcacacatacatggaggacctcgcatgaagaagaaaaaattaggctatctcgcccatgcggctatacactcctcacaagcacggggggttggtgcactgctagacgacagtgcttcccgagaagatgtatcttgnctagcagaacaataggaagagacggaggtgacgcgatcgagctatcataagcgggaaacaacggagtcttcgctcctgtataagcgacgtagactaggaacgcacgcgacgtggggcgaagcccacgtacgaaaan

SEQ ID NO: 89794 - protein, 85 aa, Zea mays
  misc_feature: Ceres CLONE 1577588
MVGGGGGGPLRPVGKYEVGRTIGERDLRPGQVRAENPDRGEGRHERASTASFHPSRTRMARTPFNKTKLSLKSKAWVEEFPKGLL

SEQ ID NO: 89795 - DNA, 843 bp, Zea mays
  misc_feature: Ceres CLONE 1577589
  misc_feature: Encodes the peptide sequence at SEQ ID NO. 89796
  misc_feature (535)..(535): n is a, c, t, g, unknown, or other
  misc_feature (583)..(583): n is a, c, t, g, unknown, or other
  misc_feature (589)..(589): n is a, c, t, g, unknown, or other
  misc_feature (591)..(591): n is a, c, t, g, unknown, or other
  misc_feature (646)..(646): n is a, c, t, g, unknown, or other
  misc_feature (666)..(666): n is a, c, t, g, unknown, or other
  misc_feature (667)..(667): n is a, c, t, g, unknown, or other
ctccccgcggtggcggccgctctagaactagtggatcccccgggctgcaggaattcgtctcacccctagaaaaaagcctcgagcaccgggacctgccgcgtgcttcttactggcaacttggcaagtggcacggccgcacggatccatctccatcgtcgaggcgaggacgaggaagcagatcgaagcacccaaccacaccacactggtggtgagtggttgctggcgatggccatggaagcgatgatgagcgggctcaactccggcgtggtgctcagcctgatcgccgtgctgtggacggtggtgtggcagaacctgcagcacctgcagctgcagcagttcttcgcgcggcagctgagccggcgcgcgcggcggctggcggcgatggtggacccgtacctgtcggtcaccatcgccgagtacgagggcgggcggatgaagcgcagcgacgcgtacgaggaggtcaaggcctacctcagcgacgccagcgcccacggcgtgcgccacctccgggccgagtccgccaaggacgccgacnagctcgtgctcagcatgtcggacggcgaggaggtggagggacgactcnagggcncnagggtctggtggtggggcctactccaaggcggccgccgcgctcggaacggccccncggcttggttgaaaagtggnnggggggggccctcccgcgaaaaggaagaagaggcccattttttaccggccctttttttttccggggaaccacccaaaccgggttccccttggggggtgggaaaacaagtaacctttcccgcgggcgggtttccgccacaagtttgggggcccccccccccccttctacagtgggag

SEQ ID NO: 89796 - protein, 206 aa, Zea mays
  misc_feature: Ceres CLONE 1577589
  misc_feature (104)..(104): Xaa is any aa, unknown, or other
  misc_feature (120)..(120): Xaa is any aa, unknown, or other
  misc_feature (122)..(122): Xaa is any aa, unknown, or other
  misc_feature (141)..(141): Xaa is any aa, unknown, or other
  misc_feature (148)..(148): Xaa is any aa, unknown, or other
MAMEAMMSGLNSGVVLSLIAVLWTVVWQNLQHLQLQQFFARQLSRRARRLAAMVDPYLSVTIAEYEGGRMKRSDAYEEVKAYLSDASAHGVRHLRAESAKDADXLVLSMSDGEEVEGRLXGXRVWWWGLLQGGRRARNGPXAWLKSGXGGPSREKEEEAHFLPALFFSGEPPKPGSPWGVGKQVTFPAGGFPPQVWGPPPPLLQWE

SEQ ID NO: 89797 - DNA, 800 bp, Zea mays
  misc_feature: Ceres CLONE 1577594
ggagctcaccgcggtggcggccgctctagaactagtggatcccccgggctgcaggaattcgtctcacccctagaaaaactcatattattactaattattagcctatgatgaataaaatggtgatgggttaattcatttcatttcacaaatcaaacaaaaaaagtgatgagtgggaatgtgatgaactacctcattcttcaaacctaacacactgtaaatctctctctagcacgtaagcgtttctgatctctcataaagggtggtctagtttcgttcctgaaaacaatttctggggacaaagagagaagggacactggttgcaagatacctcaaaaaaattaagttgccctgttccagcttcttctctcaaccatgctgatttcttacattgtgtaaaggtgacgttgacgtccttagggctagtttgggagctacattttaccaagtgattcctattttttcaaagtaaaataaactaatttcccttgggaaaataaaaatcccttgagagaacgaggttccaaactaaccctaatgatatgcatttccttttttttgcagttgatactctaaagtcgtatgatcgattctacatattgaagaaaaaacaggccttcgctatggtacttcgtttatatttgattttaccaatatttaatgcatcatgtgcataataagcaaccaagaatggagttacccaccaacgtagaagaatgaattagatttggcgagcacatacagcacctgagtctttcctttcatgcgctccgtagggagagaacggacggagaagagaaaaa

SEQ ID NO: 89798 - DNA, 818 bp, Zea mays
  misc_feature: Ceres CLONE 1577595
  misc_feature: Encodes the peptide sequence at SEQ ID NO. 89799
ccccgcggtggcggccgctctagaactagtggatcccccgggctgcaggaattcgtctcacccctagaaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctggaatgactatggctgttgccttacaagctgaaagaagtgtcattgaaaagaagaaacccgatatcaaacaaaggaagggtggttgtcactggcatgggtgtagtgacaccattggggcccatgatcctgacgtgttttacaacaatcttcttgatggtgttagcgggaataagtgagatttgagaggtttgactgttccaaca

SEQ ID NO: 89799 - protein, 118 aa, Zea mays
  misc_feature: Ceres CLONE 1577595
MAAVAGPLCTWLVAACLSAACDAEEHKQKHFCAGGSRAGGGVMLGQRRRLGARRRGLARSGMTMAVALQAERSVIEKKKPDIKQRKGGCHWHGCSDTIGAHDPDVFYNNLLDGVSGNK

SEQ ID NO: 89800 - DNA, 1008 bp, Zea mays
  misc_feature: Ceres CLONE 1577596
  misc_feature: Encodes the peptide sequence at SEQ ID NO. 89801
  misc_feature (1)..(1): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (94)..(94): n is a, c, t, g, unknown, or other
ngggggaggagngnnncgttgacggcctcctaccagttctcagcaagaaaggaaggggaaaacnnnnncttnnnnnttaaactggaactcaccncggtggcggccgctctagaactagtggatcccccgggctgcaggaattcgtctcacccctagaaaagatcacacaacccaaagcagccacagcagactcctttcctcctctcactctcgctcgcgctgcgctcgctacctcgcttcgcattccattccaaaagaggggaggaaaggcaagatgttcatcgagagcttccgcgtcgagagcccccacgtgcggtacggcccgatggagatcgagtccgagtaccggtaccacacgacggagctggtacacgagggcaaggacggcgcctcacgctgggtcgtccgccccaagtccgtcaagtacaacttccggaccagaaccgccgtccccaagctcggggagatgcttgtggggtggggaggcaacaacgggtccacgctgacggctggggtcattgccaacagggagggggatctcatgggcgaccaaggacaaggtgcagcaagcccaactactacggctccctcacccaggcctccaccatcagagtccggcgcctacaacgggggaagaacacctatgccgccgcttcaaagaaccctcccttccccattaacggaacccccacaaccgacacttggtgtttccgggagggcttggggaacatttagggaaacaatgaaaaccctgggcccgaacctcccatgaacccgggggccaaaagggggcccttgggataaatggaaccctggccacaaaaactggctttcaaggcccccaaaccatggggaagttcccaatggggtgccccaacttttcccccggggaaaatcccacatggaaaccccgggaaacatattcaactcgaccgggggctaaaaaccacgagaggcagtctcctctcaccctcccgaaaaagaagtgggtttcattgttccaaaaag

SEQ ID NO: 89801 - protein, 165 aa, Zea mays
  misc_feature: Ceres CLONE 1577596
  misc_feature: SWISSPROT Homolog: EC 5.5.1.4 Inositol-3-phosphate synthase
MFIESFRVESPHVRYGPMEIESEYRYHTTELVHEGKDGASRWVVRPKSVKYNFRTRTAVPKLGEMLVGWGGNNGSTLTAGVIANREGDLMGDQGQGAASPTTTAPSPRPPPSESGAYNGGRTPMPPLQRTLPSPLTEPPQPTLGVSGRAWGTFRETMKTLGPNLP

SEQ ID NO: 89802 - DNA, 889 bp, Zea mays
  misc_feature: Ceres CLONE 1577600
  misc_feature: Translation starting site: 225
ggcggccgctctagaactagtggatcccccgggctgcaggaattcgtctcacccctagaaaaactgccgcacaacgatccgagcgcgcccgtccctggcccagaagatcccaacgccgggcgcgcgtccccatccgtccgccgcgccggggtatctatcgcggcgtcgtggggtcggagctccgggtccggggccgggcaggcgggaagcagggcgcaagcgcaatggtggagatagggagccgggtgcgggggttcctgcggaaccggtggctggtgttcgtggcgtcgatgtggatgcagtcctgcgccggggtcggctacctattcggcagcctctcgccggtgatcaagggcctcgctcgggtacaaccagcgccaggtggccgggctcggcgtcgccaaggacctgggcgacagcgtcggcttcctcgccggcacgctctgctccgtgctcccgctctgggccgcgctcctcgtcggcgccgcgcaaaacctcgtccgatacggatgggtctggggctcgccgtcccgcgcccgggtcccccgtgccccccgctctggggggatgtgcaattcaaatccttcctcgggaaaaaatggtgaagaaatactttaaacccttgctgccctttggtctcggggtgtttcagaaacttccccccaagaacccgggggaaccaatttgttgggtattcccccaaagggattcccctggggtttaagtggggggcaattttctaaccaccagattttttgggcaattgggggcccccctccctgaggaaaggccgccgccgggaaccttccaaggggtgcccagtttgggccccaacaaaagaaagtgtaaaaagcgctttataagtttcccatttattagaaacgccgtg

SEQ ID NO: 89803 - DNA, 1077 bp, Zea mays
  misc_feature: Ceres CLONE 1577601
  misc_feature: Encodes the peptide sequence at SEQ ID NO. 89804
  misc_feature (28)..(28): n is a, c, t, g, unknown, or other
  misc_feature (29)..(29): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (66)..(66): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ttgtaggagtgggggggcgtcacctgcnntttggggccaccaaaaaaggggggggctgnnnnnaanaaaannnaaaaactggagctccccgcggtggcggccgctctagaatagtggatcccccgggctgcaggaattcgtctcacccctagaaaaagtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagcctatggccctttcaaagtgatccccgggctcccggcgaacaagcccatgatcgggggtggcaggttccaggggccgaaggaaaaaaaaaattttctcgggcccgaagaagaaaccaccctcccaagggattccctggaaaccaagaattgaaaagggaaaaaccgggccccaaagggcttttaaaccttccgggggccccccccccccttttcaaaggaaaacgcccctgggttccgtccacccccgggtccccgcgggggcctttacattttcaaacgggaatctcccccaaaggcgccacaggggccccacccaagggggaacggccggggggggttaatattttcccgggggccctctaaagcgggcaattggggcaattctataacaaacgaaaggcccaccaccgcccccggggggcccaatcggaaaaaaagggggcttcgcaaaaagaaaaagttaagaacaacccgcaccggcaaaaaaaaaaaaaaatccccccattttttttgaacactgggggggg

SEQ ID NO: 89804 - protein, 97 aa, Zea mays
  misc_feature: Ceres CLONE 1577601
MAGKGDGPAIGIDLGTTYSCVGVWQHDRVEIIANDQGNRTTPSYVAFTDSERLVGDAAKNQVAMNPINTVFDAKRLIGRRFSDTSVQSDAKPMALSK
